(12) United States Patent
Dundon et al.

(10) Patent No.: US 8,017,376 B2
(45) Date of Patent: Sep. 13, 2011

(54) METHODS OF INCREASING DIHYDROXY ACID DEHYDRATASE ACTIVITY TO IMPROVE PRODUCTION OF FUELS, CHEMICALS, AND AMINO ACIDS

(75) Inventors: Catherine Asleson Dundon, Englewood, CO (US); Aristos Aristidou, Highlands Ranch, CO (US); Andrew Hawkins, Parker, CO (US); Doug Lies, Parker, CO (US); Lynne H. Albert, Golden, CO (US)

(73) Assignee: Gevo, Inc., Englewood, CO (US)

( * ) Notice: Subject to any disclaimer, the term of this patent is extended or adjusted under 35 U.S.C. 154(b) by 0 days.

(21) Appl. No.: 12/953,884

(22) Filed: Nov. 24, 2010

(65) Prior Publication Data
US 2011/0183393 A1 Jul. 28, 2011

Related U.S. Application Data

(60) Provisional application No. 61/263,952, filed on Nov. 24, 2009, provisional application No. 61/350,209, filed on Jun. 1, 2010.

(51) Int. Cl.
*C12N 1/00* (2006.01)
*C07H 21/02* (2006.01)

(52) U.S. Cl. ..................... 435/254.2; 536/23.1

(58) Field of Classification Search ........... None
See application file for complete search history.

(56) References Cited

U.S. PATENT DOCUMENTS

| | | | |
|---|---|---|---|
| 7,851,188 B2 | 12/2010 | Donaldson et al. | |
| 2008/0274526 A1 | 11/2008 | Bramucci et al. | |
| 2009/0075327 A1 | 3/2009 | Busby et al. | |
| 2009/0081746 A1 | 3/2009 | Liao et al. | |
| 2009/0215137 A1 | 8/2009 | Hawkins et al. | |
| 2009/0226990 A1 | 9/2009 | Hawkins et al. | |
| 2009/0226991 A1 | 9/2009 | Feldman et al. | |
| 2009/0305363 A1 | 12/2009 | Anthony et al. | |
| 2010/0081154 A1 | 4/2010 | Flint et al. | |
| 2010/0081179 A1 | 4/2010 | Anthony et al. | |
| 2010/0081182 A1 | 4/2010 | Paul et al. | |
| 2010/0081183 A1 | 4/2010 | Paul et al. | |

(Continued)

FOREIGN PATENT DOCUMENTS

WO WO2009076480 6/2009

(Continued)

OTHER PUBLICATIONS

Belli et al. "*Saccharomyces cerevisiae* glutaredoxin 5-deficient cells subjected to continuous oxidizing conditions are affected in the expression of specific sets of genes." J. Biol. Chem. 279:13, 12386-12395 (Mar. 26, 2004).

(Continued)

*Primary Examiner* — Alexander Kim
(74) *Attorney, Agent, or Firm* — Cooley LLP

(57) ABSTRACT

The present invention is directed to recombinant microorganisms comprising one or more dihydroxyacid dehydratase (DHAD)-requiring biosynthetic pathways and methods of using said recombinant microorganisms to produce beneficial metabolites derived from said DHAD-requiring biosynthetic pathways. In various aspects of the invention, the recombinant microorganisms may be engineered to overexpress one or more polynucleotides encoding one or more Aft proteins or homologs thereof. In some embodiments, the recombinant microorganisms may comprise a cytosolically localized DHAD enzyme. In additional embodiments, the recombinant microorganisms may comprise a mitochondrially localized DHAD enzyme. In various embodiments described herein, the recombinant microorganisms may be microorganisms of the *Saccharomyces* clade, Crabtree-negative yeast microorganisms, Crabtree-positive yeast microorganisms, post-WGD (whole genome duplication) yeast microorganisms, pre-WGD (whole genome duplication) yeast microorganisms, and non-fermenting yeast microorganisms.

20 Claims, 7 Drawing Sheets

U.S. PATENT DOCUMENTS

| | | | |
|---|---|---|---|
| 2010/0129886 A1 | 5/2010 | Anthony et al. |
| 2010/0129887 A1 | 5/2010 | Anthony |
| 2010/0143997 A1 | 6/2010 | Buelter et al. |
| 2010/0209986 A1 | 8/2010 | Liao et al. |
| 2011/0020889 A1 | 1/2011 | Feldman et al. |
| 2011/0053235 A1 | 3/2011 | Festel et al. |
| 2011/0124060 A1 | 5/2011 | Anthony et al. |

FOREIGN PATENT DOCUMENTS

| | | |
|---|---|---|
| WO | WO2010075504 | 7/2010 |
| WO | WO2011019894 | 2/2011 |

OTHER PUBLICATIONS

Berthelet et al. "Functional genomics analysis of the *Saccharomyces cerevisiae* iron responsive transcription factor Aft1 reveals iron-independent functions." Genetics 185: 1111-1128 (Jul. 2010).

Blaiseau et al. "Aft2p a novel iron-regulated transcription activator that modulates, with Aft1p, intracellular iron use and resistance to oxidative stress in yeast" J. Biol. Chem. 276:36, 34221-34226 (Sep. 7, 2001).

Casas et al. "The AFT1 transcriptional factor is differentially required for expression of high-affinity iron uptake genes in *Saccharomyces cerevisiae*." Yeast 13:621-637 (1997).

Conde e Silva et al. "KlAft, the Kluyveromyces Lactis ortholog of Aft1 and Aft2, mediates activation of iron-responsive transcription through the PuCACCC Aft-type sequence." Genetics 183: 93-106 (Sep. 2009).

Courel et al. "Direct activation of genes involved in intracellular iron use by the yeast iron-responsive transcription factor Aft2 without its paralog Aft1." Molec. & Cell. Biol. 25:15, 6760-6771 (Aug. 2005).

Dubacq et al. "Role of the iron mobilization and oxidative stress regulons in the genomic response of yeast to hydroxyurea." Mol. Gen. Genomics 275: 114-124 (2006).

Foury et al. "Mitochondrial control of iron homeostasis. A genome wide analysis of gene expression in a yeast frataxin-deficient strain." J. Biol. Chem. 276:11 (Mar. 16, 2001).

Garcia et al. "Isolation of a Candida Albicans gene, tightly linked to URA3, coding for a putative transcription factor that supresses a *Saccharomyces cerevisiae* aft1 mutation." Yeast 18:301-311 (2001).

Haas et al. "Siderophores in fungal physiology and virulence." Ann. Rev. Phytopathol. 46: 149-87 (2008).

Haurie et al. "The Snf1 protein kinase controls the induction of genes of the iron uptake pathway at the diauxic shift in *Saccharomyces cerevisiae*." J. Biol. Chem. 278:46 45391-45396 (Nov. 14, 2003).

Hausmann et al. "Cellular and mitochondrial remodeling upon defects in iron-sulfur protein biogenesis." J. Biol. Chem. 283:13 8318-8330 (Mar. 28, 2008).

Herrero et al. "Monothiol glutaredoxins: a common domain for multiple functions." Cell. Mol. Life Sci. 64 1518-1530 (2007).

Ihrig et al. "Iron regulation through the back door: iron-dependent metabolite levels contribute to transcriptional adaptation to iron deprivation in *Saccharomyces cerevisiae*." Eukaryotic Cell 460-471 (Mar. 2010).

Jeong et al. "A novel function of Aft1 in regulating ferrioxamine B uptake: Aft1 modulates Arn3 ubiquitination in *Saccharomyces cerevisiae*." Biochem J. 422:181-191 (2009).

Kumánovics et al. "Identification of FRA1 and FRA2 as genes involved in regulating the yeast iron regulon in response to decreased mitochondrial iron-sulfur cluster synthesis." J. Biol. Chem. 283:16, 10276-10286 (Apr. 18, 2008).

Kwok et al. "Iron in yeast: mechanisms involved in homeostasis." Topics in Current Genetics. D01 10.1007/4735_92 (Published online Jul. 29, 2005).

Li et al. "The yeast iron regulatory proteins Grx3/4 and Fra2 form heterodimeric complexes containing a [2Fe-2S] cluster with cysteinyl and histidyl ligation." Biochem 48, 9569-9581 (2009).

Li et al. "A mitochondrial-vacuolar signaling pathway in yeast that affects iron and copper metabolism." J. Biol. Chem. 279:32, 33653-33661 (Aug. 6, 2004).

Li et al. "Histidine 103 in Fra2 is an iron-sulfur cluster ligand in the [2Fe-2S] Fra2-Grx3 complex and is required for in vivo iron signaling in yeast." J. Biol. Chem 286:1, 867-876 (Jan. 7, 2011).

Liang et al. "Role of Candida albicans Aft2p transcription factor in ferric reductase activity, morphogenesis and virulence." Microbiology 156, 2912-2919 (2010).

Lill et al. "Maturation of iron-sulfur proteins in eukaryotes: mechanisms, connected processes and diseases." Ann. Rev. Biochem. 77, 669-700 (Nov. 11, 2008).

Measday et al. "Systematic yeast synthetic lethal and synthetic dosage lethal screens identify genes required to chromosome segregation." PNAS, 102:39, 13956-13961 (Sep. 27, 2005).

Miao et al. "Biophysical investigation of the iron in Aft1-1up and Gal-YAH1 *Saccharomyces cerevisiae*." Biochemistry 50, 2660-2611 (2011).

Mühlenhoff et al. "A specific role of the yeast mitochondrial carriers Mrs3/4p in mitochondrial iron acquisition under iron-limiting conditions." J. Biol. chem 278:42, 40612-40620 (Oct. 17, 2003).

Ojeda et al. "Role of glutaredoxin-3 and glutaredoxin-4 in the iron regulation of the Aft1 transcriptional activator in *Saccharomyces cerevisiae*." J. Biol. Chem. 281:26, 17661-17669 (Jun. 30, 2006).

Pagani et al. "Disruption of iron homeostasis in *Saccharomyces cerevisiae* by high zinc levels: a genome-wide study." Molec. Microbiol. 65:2, 521,537 (2007).

Philpott et al. "Cell-cycle arrest and inhibition of G1 cyclin translation by iron in Aft1-1up yeast." EMBO Journal 17:17, 5026-5036 (1998).

Protchenko et al. "Three cell wall mannoproteins facilitate the uptake of iron in *Saccharomyces cerevisiae*." J. Biol. Chem. 276:52, 49244-49250 (Dec. 28, 2001).

Pujol-Carrion et al. "Glutaredoxins Grx3 and Grx4 regulate nuclear localisation of Aft1 and the oxidative stress response in *Saccharomyces cerevisiae*." J. Cell Science 119, 4554-4564 (2006).

Rutherford et al. "Metal-responsive transcription factors that regulate iron, zinc, and copper homeostasis in eukaryotic cells." Eukaryotic Cell, 3:1, 1-13 (Feb. 2004).

Rutherford et al. "Aft1p and Aft2p mediate iron-responsive gene expression in yeast through related promoter elements." J. Biol. Chem. 278:30, 27636-27643 (Jul. 25, 2003).

Rutherford et al. "Activation of the iron regulon by the yeast Aft1/Aft2 transcription factors depends on mitochondrial but not cytosolic iron-sulfur protein biogenesis." J. Biol. Chem. 280:11, 10135-10140 (Mar. 18, 2005).

Rutherford et al. "A second iron-regulatory system in yeast independent of Aft1p." PNAS 98:25, 14322-14327 (Dec. 4, 2001).

Salin et al. "Structure and properties of transcriptional networks driving selenite stress response in yeasts." MBC Genomics 9:333 (2008).

Shakoury-Elizeh, et al. "Transcriptional remodeling in response to iron deprivation in *Saccharomyces cerevisiae*." Molec. Biol. of the Cell 15, 1233-1243 (Mar. 2004).

Shakoury-Elizeh, et al. "Metabolic response to iron deficiency in *Saccharomyces cerevisiae*." J. Biol. Chem 285:19, 14823-14833 (May 7, 2010).

Ueta et al. "Pse1p mediates the nuclear import of the iron-responsive transcription factor Aft1p in *Saccharomyces cerevisiae*." J. Biol. Chem. 278:50, 50120-50127 (Dec. 12, 2003).

Ueta et al. "Mechanism underlying the iron-dependent nuclear export of the iron-responsive transcription factor Aft1p in *Saccharomyces cerevisiae*." Molec. Biol. Cell 18, 2890-2990 (Aug. 2007).

Vergara et al. "Post-transcriptional regulation of gene expression in response to iron deficiency: co-ordinated metabolic reprogramming by yeast mRNA-binding proteins." Biochem. Soc. Trans. 36:5 (2008).

Yamaguchi-Iwai et al. "Subcellular localization of Aft1 transcription factor responds to iron status in *Saccharomyces cerevisiae*." J. Biol. Chem. 277:21, 18914-18918 (May 24, 2002).

Yamaguchi-Iwai et al. "AFT1: a mediator of iron regulated transcriptional control in *Saccharomyces cerevisiae*." EMBO Journal 14:6, 1231-1239 (1995).

Yamaguchi-Iwai et al. "Iron-regulated DNA binding by the Aft1 protein controls the iron regulon in yeast." EMBO Journal 15:13 (1996).

Kawahata et al. "Yeast genes involved in response to lactic acid and acetic acid: acidic conditions caused by the organic acids in *Saccharomyces cerevisiae* cultures induce expression of intracellular metal metabolism genes regulated by Aft1p." FEMS Yeast Res. 6, 924-936 (2006).

PCT/US10/57957, Applicant: Gevo, Inc. Int'l Search Report-Written Opinion (Apr. 8, 2011).

US 8,017,376 B2

METHODS OF INCREASING DIHYDROXY ACID DEHYDRATASE ACTIVITY TO IMPROVE PRODUCTION OF FUELS, CHEMICALS, AND AMINO ACIDS

CROSS-REFERENCE TO RELATED APPLICATIONS

This application claims priority to U.S. Provisional Application Ser. No. 61/263,952, filed Nov. 24, 2009, and U.S. Provisional Application Ser. No. 61/350,209, filed Jun. 1, 2010, both of which are herein incorporated by reference in their entireties for all purposes.

ACKNOWLEDGMENT OF GOVERNMENTAL SUPPORT

This invention was made with government support under Contract No. HP-0823122, awarded by the National Science Foundation, and under Contract No. EP-D-09-023, awarded by the Environmental Protection Agency. The government has certain rights in the invention.

TECHNICAL FIELD

Recombinant microorganisms and methods of producing such organisms are provided. Also provided are methods of producing beneficial metabolites including fuels, chemicals, and amino acids by contacting a suitable substrate with recombinant microorganisms and enzymatic preparations therefrom.

DESCRIPTION OF THE TEXT FILE SUBMITTED ELECTRONICALLY

The contents of the text file submitted electronically herewith are incorporated herein by reference in their entirety: A computer readable format copy of the Sequence Listing (filename: GEVO_041_09US_SeqList_ST25.txt, date recorded: Nov. 23, 2010, file size: 658 kilobytes).

BACKGROUND

Dihydroxyacid dehydratase (DHAD) is an enzyme that catalyzes the conversion of 2,3-dihydroxyisovalerate to α-ketoisovalerate and of 2,3-dihydroxy-3-methylvalerate to 2-keto-3-methylvalerate. This enzyme plays an important role in a variety of biosynthetic pathways, including pathways producing valine, isoleucine, leucine and pantothenic acid (vitamin B5). DHAD also catalyzes the conversion of 2,3-dihydroxyisovalerate to α-ketoisovalerate as part of isobutanol biosynthetic pathways disclosed in commonly owned and co-pending US Patent Publication Nos. 2009/0226991 and 2010/0143997: In addition, biosynthetic pathways for the production of 3-methyl-1-butanol and 2-methyl-1-butanol use DHAD to convert 2,3-dihydroxyisovalerate to α-ketoisovalerate and 2,3-dihydroxy-3-methylvalerate to 2-keto-3-methylvalerate, respectively (Atsumi et al., 2008, Nature 451(7174): 86-9).

DHAD is an essential enzyme in all of these biosynthetic pathways, hence, it is desirable that recombinant microorganisms engineered to produce the above-mentioned compounds exhibit optimal DHAD activity. The optimal level of DHAD activity will typically have to be at levels that are significantly higher than those found in non-engineered microorganisms in order to sustain commercially viable productivities, yields, and titers. The present application addresses this need by engineering recombinant microorganisms to improve their DHAD activity.

SUMMARY OF THE INVENTION

The present inventors have discovered that overexpression of the transcriptional activator genes AFT1 and/or AFT2 or homologs thereof in a recombinant yeast microorganism improves DHAD activity. Thus, the invention relates to recombinant yeast cells engineered to provide increased heterologous or native expression of AFT1 and/or AFT2 or homologs thereof. In general, cells that overexpress AFT1 and/or AFT2 or homologs thereof exhibit an enhanced ability to produce beneficial metabolites such as isobutanol, 3-methyl-1-butanol, 2-methyl-1-butanol, valine, isoleucine, leucine, and pantothenic acid.

One aspect of the invention is directed to a recombinant microorganism comprising a DHAD-requiring biosynthetic pathway, wherein said microorganism is engineered to overexpress one or more polynucleotides encoding one or more Aft proteins or homologs thereof. In one embodiment, the Aft protein is selected from SEQ ID NO: 2, SEQ ID NO: 4, SEQ ID NO: 6, SEQ ID NO: 8, SEQ ID NO: 10, SEQ ID NO: 12, SEQ ID NO: 14, SEQ ID NO: 16, SEQ ID NO: 18, SEQ ID NO: 20, SEQ ID NO: 22, SEQ ID NO: 24, SEQ ID NO: 26, SEQ ID NO: 28, SEQ ID NO: 30, SEQ ID NO: 32, SEQ ID NO: 34, SEQ ID NO: 36, SEQ ID NO: 209, SEQ ID NO: 211, SEQ ID NO: 213, SEQ ID NO: 215, SEQ ID NO: 217, SEQ ID NO: 219, SEQ ID NO: 221, SEQ ID NO: 223, and SEQ ID NO: 225. In another embodiment, one or more of the polynucleotides encoding said one or more Aft proteins or homologs thereof is a native polynucleotide. In yet another embodiment, one or more of the polynucleotides encoding said one or more Aft proteins or homologs thereof is a heterologous polynucleotide.

In a specific embodiment according to this aspect, the invention is directed to a recombinant microorganism comprising a DHAD-requiring biosynthetic pathway, wherein said microorganism has been engineered to overexpress a polynucleotide encoding Aft1 (SEQ ID NO: 2) and/or Aft2 (SEQ ID NO: 4) or a homolog thereof. In one embodiment, the polynucleotide encoding the Aft protein or homolog thereof is native to the recombinant microorganism. In another embodiment, the polynucleotide encoding the Aft protein or homolog thereof is heterologous to the recombinant microorganism.

Another aspect of the invention is directed to a recombinant microorganism comprising a DHAD-requiring biosynthetic pathway, wherein the activity of one or more Aft proteins or homologs thereof is increased. In one embodiment, the Aft protein is selected from SEQ ID NO: 2, SEQ ID NO: 4, SEQ ID NO: 6, SEQ ID NO: 8, SEQ ID NO: 10, SEQ ID NO: 12, SEQ ID NO: 14, SEQ ID NO: 16, SEQ ID NO: 18, SEQ ID NO: 20, SEQ ID NO: 22, SEQ ID NO: 24, SEQ ID NO: 26, SEQ ID NO: 28, SEQ ID NO: 30, SEQ ID NO: 32, SEQ ID NO: 34, SEQ ID NO: 36, SEQ ID NO: 209, SEQ ID NO: 211, SEQ ID NO: 213, SEQ ID NO: 215, SEQ ID NO: 217, SEQ ID NO: 219, SEQ ID NO: 221, SEQ ID NO: 223, and SEQ ID NO: 225. In one embodiment, the polynucleotide encoding the Aft protein or homolog thereof is native to the recombinant microorganism. In another embodiment, the polynucleotide encoding the Aft protein or homolog thereof is heterologous to the recombinant microorganism.

Another aspect of the invention is directed to a recombinant microorganism comprising a DHAD-requiring biosynthetic pathway, wherein said microorganism has been engineered to overexpress one or more polynucleotides encoding one or more proteins or homologs thereof regulated by an Aft protein or homolog thereof. In one embodiment, the proteins regulated by an Aft protein or homolog thereof are selected from FET3, FET4, FET5, FTR1, FTH1, SMF3, MRS4, CCC2, COT1, ATX1, FRE1, FRE2, FRE3, FRE4, FRE5, FRE6, FIT1, FIT2, FIT3, ARN1, ARN2, ARN3, ARN4, ISU1, ISU2, TIS11, HMX1, AKR1, PCL5, YOR387C, YHL035C, YMR034C, ICY2, PRY1, YDL124W, BNA2, ECM4, LAP4, YOL083W, YGR146C, BIO5, YDR271C, OYE3, CTH1, CTH2, MRS3, MRS4, HSP26, YAP2, VMR1, ECL1, OSW1, NFT1, ARA2, TAF1/TAF130/TAF145, YOR225W, YKR104W, YBR012C, and YMR041C or homologs thereof. In a specific embodiment, the protein regulated by an Aft protein or homolog thereof is ENB1. In another specific embodiment, the protein regulated by an Aft protein or homologs thereof is FET3. In yet another specific embodiment, the protein regulated by an Aft protein or homolog thereof is SMF3. In one embodiment, all genes demonstrated to increase DHAD activity and/or the production of a metabolite from a DHAD-requiring biosynthetic pathway are overexpressed. Where none of the AFT regulon genes expressed alone are effective in increasing DHAD activity and/or the production of a metabolite from a DHAD-requiring biosynthetic pathway, then 1, 2, 3, 4, 5, or more of the genes in the AFT regulon may be overexpressed together.

In various embodiments described herein, the DHAD-requiring biosynthetic pathway may be selected from isobutanol, 3-methyl-1-butanol, 2-methyl-1-butanol, valine, isoleucine, leucine, and/or pantothenic acid biosynthetic pathways. In various embodiments described herein, the DHAD enzyme which acts as part of an isobutanol, 3-methyl-1-butanol, 2-methyl-1-butanol, valine, isoleucine, leucine, and/or pantothenic acid biosynthetic pathway may be localized to the cytosol. In alternative embodiments, the DHAD enzyme which acts as part of an isobutanol, 3-methyl-1-butanol, 2-methyl-1-butanol, valine, isoleucine, leucine, and/or pantothenic acid biosynthetic pathway may be localized to the mitochondria. In additional embodiments, a DHAD enzyme which acts as part of an isobutanol, 3-methyl-1-butanol, 2-methyl-1-butanol, valine, isoleucine, leucine, and/or pantothenic acid biosynthetic pathway is localized to the cytosol and the mitochondria.

In one embodiment, the invention is directed to a recombinant microorganism for producing isobutanol, wherein said recombinant microorganism comprises an isobutanol producing metabolic pathway and wherein said microorganism is engineered to overexpress one or more polynucleotides encoding one or more Aft proteins or homologs thereof. In one embodiment, the Aft protein is selected from SEQ ID NO: 2, SEQ ID NO: 4, SEQ ID NO: 6, SEQ ID NO: 8, SEQ ID NO: 10, SEQ ID NO: 12, SEQ ID NO: 14, SEQ ID NO: 16, SEQ ID NO: 18, SEQ ID NO: 20, SEQ ID NO: 22, SEQ ID NO: 24, SEQ ID NO: 26, SEQ ID NO: 28, SEQ ID NO: 30, SEQ ID NO: 32, SEQ ID NO: 34, SEQ ID NO: 36, SEQ ID NO: 209, SEQ ID NO: 211, SEQ ID NO: 213, SEQ ID NO: 215, SEQ ID NO: 217, SEQ ID NO: 219; SEQ ID NO: 221, SEQ ID NO: 223, and SEQ ID NO: 225.

In a specific embodiment, the invention is directed to a recombinant microorganism for producing isobutanol, wherein said recombinant microorganism comprises an isobutanol producing metabolic pathway and wherein said microorganism is engineered to overexpress a polynucleotide encoding Aft1 (SEQ ID NO: 2) or a homolog thereof. In another specific embodiment, the invention is directed to a recombinant microorganism for producing isobutanol, wherein said recombinant microorganism comprises an isobutanol producing metabolic pathway and wherein said microorganism is engineered to overexpress a polynucleotide encoding Aft2 (SEQ ID NO: 4) or a homolog thereof. In yet another embodiment, the invention is directed to a recombinant microorganism for producing isobutanol, wherein said recombinant microorganism comprises an isobutanol producing metabolic pathway and wherein said microorganism is engineered to overexpress a polynucleotide encoding Aft1 (SEQ ID NO: 2) or a homolog thereof and Aft2 (SEQ ID NO: 4) or a homolog thereof.

In each of the aforementioned aspects and embodiments, the Aft protein may be a constitutively active Aft protein or a homolog thereof. In one embodiment, the constitutively active Aft protein or homolog thereof comprises a mutation at a position corresponding to the cysteine 291 residue of the native *S. cerevisiae* Aft1 (SEQ ID NO: 2). In a specific embodiment, the cysteine 291 residue is replaced with a phenylalanine residue. In another embodiment, the constitutively active Aft protein or homolog thereof comprises a mutation at a position corresponding to the cysteine 187 residue of the native *S. cerevisiae* Aft2 (SEQ ID NO: 2). In a specific embodiment, the cysteine 187 residue is replaced with a phenylalanine residue.

In another embodiment, the invention is directed to a recombinant microorganism for producing isobutanol, wherein said recombinant microorganism comprises an isobutanol producing metabolic pathway, wherein said microorganism has been engineered to overexpress one or more polynucleotides encoding one or more proteins or homologs thereof regulated by an Aft protein or homolog thereof. In one embodiment, the proteins regulated by Aft or a homolog thereof are selected from FET3, FET4, FET5, FTR1, FTH1, SMF3, MRS4, CCC2, COT1, ATX1, FRE1, FRE2, FRE3, FRE4, FRE5, FRE6, FIT1, FIT2, FIT3, ARN1, ARN2, ARN3, ARN4, ISU1, ISU2, TIS11, HMX1, AKR1, PCL5, YOR387C, YHL035C, YMR034c, ICY2, PRY1, YDL124W, BNA2, ECM4, LAP4, YOL083W, YGR146C, 8105, YDR271C, OYE3, CTH1, CTH2, MRS3, MRS4, HSP26, YAP2, VMR1, ECL1, OSW1, NFT1, ARA2, TAF1/TAF130/TAF145, YOR225W, YKR104W, YBR012C, and YMR041C or homologs thereof. In a specific embodiment, the protein regulated by an Aft protein or homolog thereof is ENB1. In another specific embodiment, the protein regulated by an Aft protein or homologs thereof is FET3. In yet another specific embodiment, the protein regulated by an Aft protein or homolog thereof is SMF3. In one embodiment, all genes demonstrated to increase DHAD activity and/or the production of a metabolite from a DHAD-requiring biosynthetic pathway are overexpressed. Where none of the AFT regulon genes expressed alone are effective in increasing DHAD activity and/or the production of a metabolite from a DHAD-requiring biosynthetic pathway, then 1, 2, 3, 4, 5, or more of the genes in the AFT regulon may be overexpressed together.

In one embodiment, the isobutanol producing metabolic pathway comprises at least one exogenous gene that catalyzes a step in the conversion of pyruvate to isobutanol. In another embodiment, the isobutanol producing metabolic pathway comprises at least two exogenous genes that catalyze steps in the conversion of pyruvate to isobutanol. In yet another embodiment, the isobutanol producing metabolic pathway comprises at least three exogenous genes that catalyze steps in the conversion of pyruvate to isobutanol. In yet another embodiment, the isobutanol producing metabolic pathway comprises at least four exogenous genes that catalyze steps in the conversion of pyruvate to isobutanol. In yet another embodiment, the isobutanol producing metabolic pathway comprises at five exogenous genes that catalyze steps in the conversion of pyruvate to isobutanol.

In one embodiment, one or more of the isobutanol pathway genes encodes an enzyme that is localized to the cytosol. In one embodiment, the recombinant microorganisms comprise an isobutanol producing metabolic pathway with at least one isobutanol pathway enzyme localized in the cytosol. In another embodiment, the recombinant microorganisms comprise an isobutanol producing metabolic pathway with at least two isobutanol pathway enzymes localized in the cytosol. In yet another embodiment, the recombinant microorganisms comprise an isobutanol producing metabolic pathway with at least three isobutanol pathway enzymes localized in the cytosol. In yet another embodiment, the recombinant microorganisms comprise an isobutanol producing metabolic pathway with at least four isobutanol pathway enzymes localized in the cytosol. In an exemplary embodiment, the recombinant microorganisms comprise an isobutanol producing metabolic pathway with five isobutanol pathway enzymes localized in the cytosol. In a further exemplary embodiment, at least one of the pathway enzymes localized to the cytosol is a cytosolically active DHAD enzyme as disclosed herein.

In various embodiments described herein, the isobutanol pathway genes encodes enzyme(s) selected from the group consisting of acetolactate synthase (ALS), ketol-acid reductoisomerase (KAR1), dihydroxyacid dehydratase (DHAD), 2-keto-acid decarboxylase (KIVD), and alcohol dehydrogenase (ADH).

Another aspect of the invention is directed to a recombinant microorganism comprising a DHAD-requiring biosynthetic pathway, wherein said microorganism has been engineered to overexpress a polynucleotide encoding Grx3 and/or Grx4 or a homolog thereof. In one embodiment, the polynucleotide encoding the Grx protein or homolog thereof is native to the recombinant microorganism. In another embodiment, the polynucleotide encoding the Grx protein or homolog thereof is heterologous to the recombinant microorganism.

In various embodiments described herein, the recombinant microorganism may be engineered reduce the concentration of reactive oxygen species (ROS) in the recombinant microorganism. Thus, the recombinant microorganisms may be engineered to express one or more proteins that reduce the concentration of reactive oxygen species (ROS) in said cell. The proteins to be expressed for reducing the concentration of reactive oxygen species may be selected from catalases, superoxide dismutases, metallothioneins, and methionine sulphoxide reductases. In a specific embodiment, said catalase may be encoded by one of more of the genes selected from the group consisting of the *E. coli* genes katG and katE, the *S. cerevisiae* genes CTT1 and CTA1, or homologs thereof. In another specific embodiment, said superoxide dismutase is encoded by one of more of the genes selected from the group consisting of the *E. coli* genes sodA, sodB, sodC, the *S. cerevisiae* genes SOD1 and SOD2, or homologs thereof. In another specific embodiment, said metallothionein is encoded by one of more of the genes selected from the group consisting of the *S. cerevisiae* CUP1-1 and CUP1-2 genes or homologs thereof. In another specific embodiment, said metallothionein is encoded by one or more genes selected from the group consisting of the *Mycobacterium tuberculosis* MymT gene and the *Synechococcus* PCC 7942 SmtA gene or homologs thereof. In another specific embodiment, said methionine sulphoxide reductase is encoded by one or more genes selected from the group consisting of the *S. cerevisiae* genes MXR1 and MXR2, or homologs thereof.

In some embodiments, the recombinant microorganism may be engineered to increase the level of available glutathione in the recombinant microorganism. Thus, the recombinant microorganisms may be engineered to express one or more proteins that increase the level of available glutathione in the cell. In one embodiment, the proteins are selected from glutaredoxin, glutathione reductase, glutathione synthase, and combinations thereof. In a specific embodiment, said glutaredoxin is encoded by one of more of the genes selected from the group the *S. cerevisiae* genes GRX2, GRX4, GRX6, and GRX7, or homologs thereof. In another specific embodiment, said glutathione reductase is encoded by the *S. cerevisiae* genes GLR1 or homologs thereof. In another specific embodiment, said glutathione synthase is encoded by one of more of the genes selected from the *S. cerevisiae* genes GSH1 and GSH2, or homologs thereof. In some embodiments, two enzymes are expressed to increase the level of available glutathione in the cell. In one embodiment, the enzymes are γ-glutamyl cysteine synthase and glutathione synthase. In a specific embodiment, said glutathione synthase is encoded by one of more of the genes selected from the group the *S. cerevisiae* genes GSH1 and GSH2, or homologs thereof.

In some embodiments, it may be desirable to overexpress one or more functional components of the thioredoxin system, as overexpression of the functional components of the thioredoxin system can increase the amount of bioavailable thioredoxin. In one embodiment, the functional components of the thioredoxin system may be selected from a thioredoxin and a thioredoxin reductase. In a specific embodiment, said thioredoxin is encoded by the *S. cerevisiae* TRX1 and TRX2 genes or homologs thereof. In another specific embodiment, said thioredoxin reductase is encoded by *S. cerevisiae* TRR1 gene or homologs thereof. In additional embodiments, the recombinant microorganism may further be engineered to overexpress the mitochondrial thioredoxin system. In one embodiment, the mitochondrial thioredoxin system is comprised of the mitochondrial thioredoxin and mitochondrial thioredoxin reductase. In a specific embodiment, said mitochondrial thioredoxin is encoded by the *S. cerevisiae* TRX3 gene or homologs thereof. In another specific embodiment, said mitochondrial thioredoxin reductase is encoded by the *S. cerevisiae* TRR2 gene or homologs thereof.

In various embodiments described herein, it may be desirable to engineer the recombinant microorganism to overexpress one or more mitochondrial export proteins. In a specific embodiment, said mitochondrial export protein may be selected from the group consisting of the *S. cerevisiae* ATM1, the *S. cerevisiae* ERV1, and the *S. cerevisiae* BAT1, or homologs thereof.

In addition, the present invention provides recombinant microorganisms that have been engineered to increase the inner mitochondrial membrane electrical potential, $\Delta\psi_M$. In one embodiment, this is accomplished via overexpression of an ATP/ADP carrier protein, wherein said overexpression increases $ATP^{4-}$ import into the mitochondrial matrix in exchange for $ADP^{3-}$. In a specific embodiment, said ATP/ADP carrier protein is encoded by the *S. cerevisiae* AAC1, AAC2, and/or AAC3 genes or homologs thereof. In another embodiment, the inner mitochondrial membrane electrical potential, $\Delta\psi_M$ is increased via a mutation in the mitochondrial ATP synthase complex that increases ATP hydrolysis activity. In a specific embodiment, said mutation is an ATP1-111 suppressor mutation or a corresponding mutation in a homologous protein.

In various embodiments described herein, it may further be desirable to engineer the recombinant microorganism to express one or more enzymes in the cytosol that reduce the concentration of reactive nitrogen species (RNS) and/or nitric oxide (NO) in said cytosol. In one embodiment, said one or more enzymes are selected from the group consisting of nitric oxide reductases and glutathione-S-nitrosothiol reductase. In a specific embodiment, said nitric oxide reductase is encoded by one of more of the genes selected from the group consisting of the *E. coli* gene norV and the *Fusarium oxysporum* gene P-450dNIR, or homologs thereof. In another specific embodiment, said glutathione-S-nitrosothiol reductase is encoded by the *S. cerevisiae* gene SFA1 or homologs thereof. In one embodiment, said glutathione-S-nitrosothiol reductase gene SFA1 is overexpressed. In another specific embodiment, said one or more enzymes is encoded by a gene selected from the group consisting of the *E. coli* gene ytfE, the *Staphylococcus aureus* gene scdA, and *Neisseria gonorrhoeae* gene dnrN, or homologs thereof.

Also provided herein are recombinant microorganisms that demonstrate increased the levels of sulfur-containing compounds within yeast cells, including the amino acid cysteine, such that this sulfur is more available for the production of iron-sulfur cluster-containing proteins in the yeast cell. In one embodiment, the recombinant microorganism has been engineered to overexpress one or more of the genes selected from the *S. cerevisiae* genes MET1, MET2, MET3, MET5, MET8, MET10, MET14, MET16, MET17, HOM2, HOM3, HOM6, CYS3, CYS4, SUL1, and SUL2, or homologs thereof. The recombinant microorganism may additionally or optionally also overexpress one or more of the genes selected from the *S. cerevisiae* genes YCT1, MUP1, GAP1, AGP1, GNP1, BAP1, BAP2, TAT1, and TAT2, or homologs thereof.

In various embodiments described herein, the recombinant microorganism may exhibit at least about 5 percent greater dihydroxyacid dehydratase (DHAD) activity as compared to the parental microorganism. In another embodiment, the recombinant microorganism may exhibit at least about 10 percent, at least about 15 percent, about least about 20 percent, at least about 25 percent, at least about 30 percent, at least about 35 percent, at least about 40 percent, at least about 45 percent, at least about 50 percent, at least about 55 percent, at least about 60 percent, at least about 65 percent, at least about 70 percent, at least about 75 percent, at least about 80 percent, at least about 100 percent, at least about 200 percent, or at least about 500 percent greater dihydroxyacid dehydratase (DHAD) activity as compared to the parental microorganism.

In various embodiments described herein, the recombinant microorganisms may be microorganisms of the *Saccharomyces* clade, *Saccharomyces* sensu stricto microorganisms, Crabtree-negative yeast microorganisms, Crabtree-positive yeast microorganisms, post-WGD (whole genome duplication) yeast microorganisms, pre-WGD (whole genome duplication) yeast microorganisms, and non-fermenting yeast microorganisms.

In some embodiments, the recombinant microorganisms may be yeast recombinant microorganisms of the *Saccharomyces* clade.

In some embodiments, the recombinant microorganisms may be *Saccharomyces* sensu stricto microorganisms. In one embodiment, the *Saccharomyces* sensu stricto is selected from the group consisting of *S. cerevisiae, S. kudriavzevii, S. mikatae, S. bayanus, S. uvarum. S. carocanis* and hybrids thereof.

In some embodiments, the recombinant microorganisms may be Crabtree-negative recombinant yeast microorganisms. In one embodiment, the Crabtree-negative yeast microorganism is classified into a genera selected from the group consisting of *Kluyveromyces, Pichia, Issatchenkia, Hansenula*, or *Candida*. In additional embodiments, the Crabtree-negative yeast microorganism is selected from *Kluyveromyces lactis, Kluyveromyces marxianus, Pichia anomala, Pichia stipitis, Hansenula anomala, Candida utilis* and *Kluyveromyces waltii*.

In some embodiments, the recombinant microorganisms may be Crabtree-positive recombinant yeast microorganisms. In one embodiment, the Crabtree-positive yeast microorganism is classified into a genera selected from the group consisting of *Saccharomyces, Kluyveromyces, Zygosaccharomyces, Debaryomyces, Candida, Pichia* and *Schizosaccharomyces*. In additional embodiments, the Crabtree-positive yeast microorganism is selected from the group consisting of *Saccharomyces cerevisiae, Saccharomyces uvarum, Saccharomyces bayanus, Saccharomyces paradoxus, Saccharomyces castelli, Saccharomyces kluyveri, Kluyveromyces thermotolerans, Candida glabrata, Z. bailli, Z. rouxii, Debaryomyces hansenii, Pichia pastorius, Schizosaccharomyces pombe*, and *Saccharomyces uvarum*.

In some embodiments, the recombinant microorganisms may be post-WGD (whole genome duplication) yeast recombinant microorganisms. In one embodiment, the post-WGD yeast recombinant microorganism is classified into a genera selected from the group consisting of *Saccharomyces* or *Candida*. In additional embodiments, the post-WGD yeast is selected from the group consisting of *Saccharomyces cerevisiae, Saccharomyces uvarum, Saccharomyces bayanus, Saccharomyces paradoxus, Saccharomyces castelli*, and *Candida glabrata*.

In some embodiments, the recombinant microorganisms may be pre-WGD (whole genome duplication) yeast recombinant microorganisms. In one embodiment, the pre-WGD yeast recombinant microorganism is classified into a genera selected from the group consisting of *Saccharomyces, Kluyveromyces, Candida, Pichia, Issatchenkia, Debaryomyces, Hansenula, Pachysolen, Yarrowia* and *Schizosaccharomyces*. In additional embodiments, the pre-WGD yeast is selected from the group consisting of *Saccharomyces kluyveri, Kluyveromyces thermotolerans, Kluyveromyces marxianus, Kluyveromyces waltii, Kluyveromyces lactis, Candida tropicalis, Pichia pastoris, Pichia anomala, Pichia stipitis, Isstachenkia orientalis, Issatchenkia occidentalis, Debaryomyces hansenii, Hansenula anomala, Pachysolen tannophilis, Yarrowia lipolytica*, and *Schizosaccharomyces pombe*.

In some embodiments, the recombinant microorganisms may be microorganisms that are non-fermenting yeast microorganisms, including, but not limited to those, classified into a genera selected from the group consisting of *Tricosporon, Rhodotorula, Myxozyma*, or *Candida*. In a specific embodiment, the non-fermenting yeast is *C. xestobii*.

In another aspect, the present invention provides methods of producing beneficial metabolites including fuels, chemicals, and amino acids using a recombinant microorganism as described herein. In one embodiment, the method includes cultivating the recombinant microorganism in a culture medium containing a feedstock providing the carbon source until a recoverable quantity of the metabolite is produced and optionally, recovering the metabolite. In one embodiment, the microorganism produces the metabolite from a carbon source at a yield of at least about 5 percent theoretical. In another embodiment, the microorganism produces the metabolite at a yield of at least about 10 percent, at least about 15 percent, about least about 20 percent, at least about 25 percent, at least about 30 percent, at least about 35 percent, at least about 40 percent, at least about 45 percent, at least about 50 percent, at least about 55 percent, at least about 60 percent, at least about 65 percent, at least about 70 percent, at least about 75 percent, at least about 80 percent, at least about 85 percent, at least about 90 percent, at least about 95 percent, or at least about 97.5 percent theoretical. The metabolite may be derived from any DHAD-requiring biosynthetic pathway, including, but not limited to, biosynthetic pathways for the production of isobutanol, 3-methyl-1-butanol, 2-methyl-1-butanol, valine, isoleucine, leucine, and pantothenic acid.

In one embodiment, the recombinant microorganism is grown under aerobic conditions. In another embodiment, the recombinant microorganism is grown under microaerobic conditions. In yet another embodiment, the recombinant microorganism is grown under anaerobic conditions.

BRIEF DESCRIPTION OF DRAWINGS

Illustrative embodiments of the invention are illustrated in the drawings, in which.

DETAILED DESCRIPTION

Figure 1:
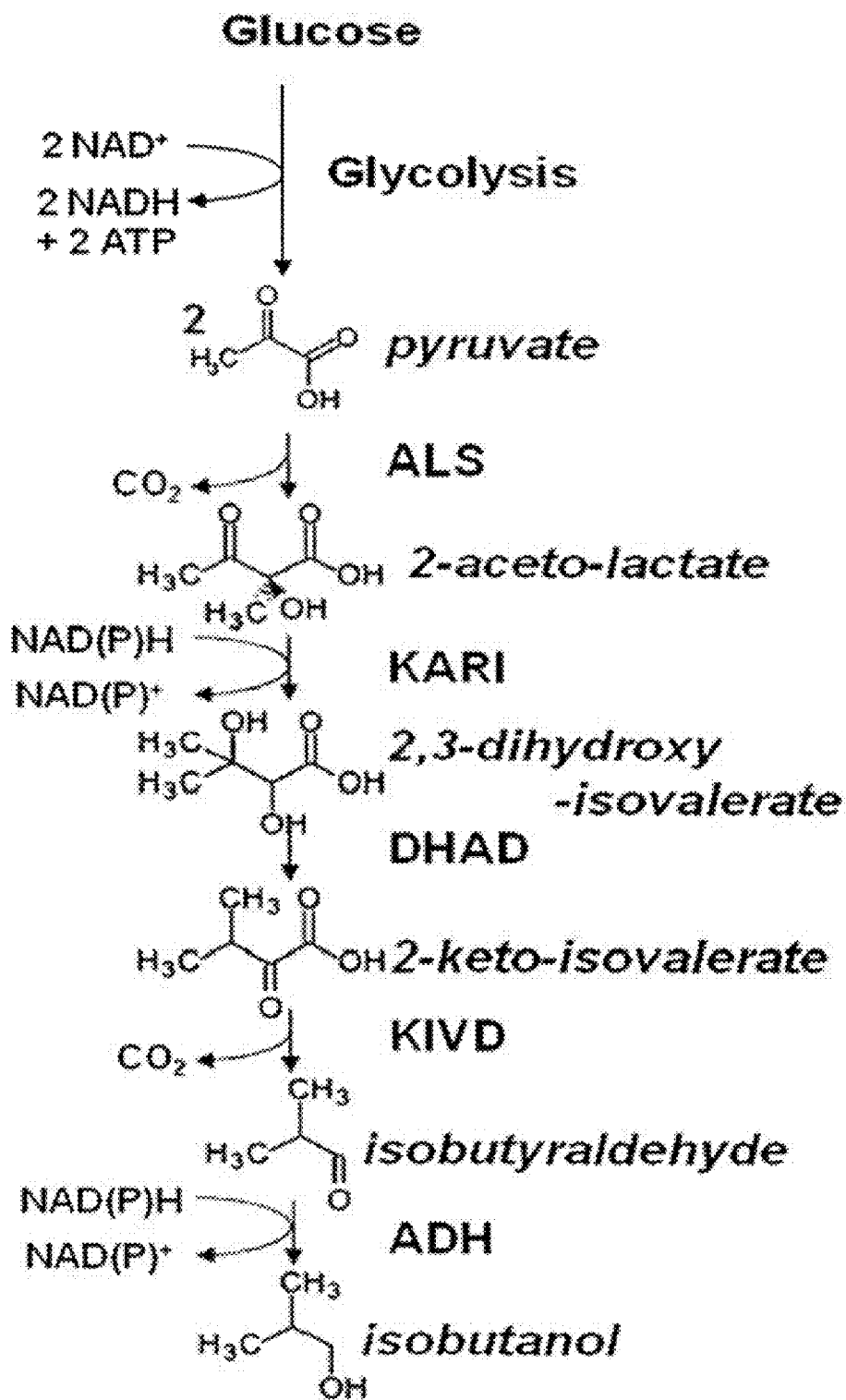
FIG. 1 illustrates an exemplary embodiment of an isobutanol pathway.

As used herein and in the appended claims, the singular forms "a," "an," and "the" include plural referents unless the context clearly dictates otherwise. Thus, for example, reference to "a polynucleotide" includes a plurality of such polynucleotides and reference to "the microorganism" includes reference to one or more microorganisms, and so forth.

Unless defined otherwise, all technical and scientific terms used herein have the same meaning as commonly understood to one of ordinary skill in the art to which this disclosure belongs. Although methods and materials similar or equivalent to those described herein can be used in the practice of the disclosed methods and compositions, the exemplary methods, devices and materials are described herein.

Any publications discussed above and throughout the text are provided solely for their disclosure prior to the filing date of the present application. Nothing herein is to be construed as an admission that the inventors are not entitled to antedate such disclosure by virtue of prior disclosure.

The term "microorganism" includes prokaryotic and eukaryotic microbial species from the Domains Archaea, Bacteria and Eucarya, the latter including yeast and filamentous fungi, protozoa, algae, or higher Protista. The terms "microbial cells" and "microbes" are used interchangeably with the term microorganism.

The term "genus" is defined as a taxonomic group of related species according to the Taxonomic Outline of Bacteria and Archaea (Garrity, G. M., Lilburn, T. G., Cole, J. R., Harrison, S. H., Euzeby, J., and Tindall, B. J. (2007) The Taxonomic Outline of Bacteria and Archaea. TOBA Release 7.7, March 2007. Michigan State University Board of Trustees. [http://www.taxonomicoutline.org/]).

The term "species" is defined as a collection of closely related organisms with greater than 97% 16S ribosomal RNA sequence homology and greater than 70% genomic hybridization and sufficiently different from all other organisms so as to be recognized as a distinct unit.

The terms "recombinant microorganism," "modified microorganism" and "recombinant host cell" are used interchangeably herein and refer to microorganisms that have been genetically modified to express or over-express endogenous polynucleotides, or to express heterologous polynucleotides, such as those included in a vector, or which have an alteration in expression of an endogenous gene. By "alteration" it is meant that the expression of the gene, or level of a RNA molecule or equivalent RNA molecules encoding one or more polypeptides or polypeptide subunits, or activity of one or more polypeptides or polypeptide subunits is up regulated or down regulated, such that expression, level, or activity is greater than or less than that observed in the absence of the alteration. For example, the term "alter" can mean "inhibit," but the use of the word "alter" is not limited to this definition.

The term "expression" with respect to a gene sequence refers to transcription of the gene and, as appropriate, translation of the resulting mRNA transcript to a protein. Thus, as will be clear from the context, expression of a protein results from transcription and translation of the open reading frame sequence. The level of expression of a desired product in a host cell may be determined on the basis of either the amount of corresponding mRNA that is present in the cell, or the amount of the desired product encoded by the selected sequence. For example, mRNA transcribed from a selected sequence can be quantitated by qRT-PCR or by Northern hybridization (see Sambrook et al., Molecular Cloning: A Laboratory Manual, Cold Spring Harbor Laboratory Press (1989)). Protein encoded by a selected sequence can be quantitated by various methods, e.g., by ELISA, by assaying for the biological activity of the protein, or by employing assays that are independent of such activity, such as western blotting or radioimmunoassay, using antibodies that recognize and bind the protein. See Sambrook et al., 1989, supra. The polynucleotide generally encodes a target enzyme involved in a metabolic pathway for producing a desired metabolite. It is understood that the terms "recombinant microorganism" and "recombinant host cell" refer not only to the particular recombinant microorganism but to the progeny or potential progeny of such a microorganism. Because certain modifications may occur in succeeding generations due to either mutation or environmental influences, such progeny may not, in fact, be identical to the parent cell, but are still included within the scope of the term as used herein.

The term "overexpression" refers to an elevated level (e.g., aberrant level) of mRNAs encoding for a protein(s) (e.g. an Aft protein or homolog thereof), and/or to elevated levels of protein(s) (e.g. Aft) in cells as compared to similar corresponding unmodified cells expressing basal levels of mRNAs (e.g., those encoding Aft proteins) or having basal levels of proteins. In particular embodiments, Aft1 and/or Aft2, or homologs thereof, or Aft regulon proteins, or homologs thereof, may be overexpressed by at least 2-fold, 3-fold, 4-fold, 5-fold, 6-fold, 8-fold, 10-fold, 12-fold, 15-fold or more in microorganisms engineered to exhibit increased Aft1 and/or Aft2, or Aft regulon mRNA, protein, and/or activity.

The term "wild-type microorganism" describes a cell that occurs in nature, i.e. a cell that has not been genetically modified. A wild-type microorganism can be genetically modified to express or overexpress a first target enzyme. This microorganism can act as a parental microorganism in the generation of a microorganism modified to express or overexpress a second target enzyme. In turn, the microorganism modified to express or overexpress a first and a second target enzyme can be modified to express or overexpress a third target enzyme.

Accordingly, a "parental microorganism" functions as a reference cell for successive genetic modification events. Each modification event can be accomplished by introducing a nucleic acid molecule in to the reference cell. The introduction facilitates the expression or overexpression of a target enzyme. It is understood that the term "facilitates" encompasses the activation of endogenous polynucleotides encoding a target enzyme through genetic modification of e.g., a promoter sequence in a parental microorganism. It is further understood that the term "facilitates" encompasses the introduction of heterologous polynucleotides encoding a target enzyme in to a parental microorganism.

The term "engineer" refers to any manipulation of a microorganism that results in a detectable change in the microorganism, wherein the manipulation includes but is not limited to inserting a polynucleotide and/or polypeptide heterologous to the microorganism and mutating a polynucleotide and/or polypeptide native to the microorganism.

The term "mutation" as used herein indicates any modification of a nucleic acid and/or polypeptide which results in an altered nucleic acid or polypeptide. Mutations include, for example, point mutations, deletions, or insertions of single or multiple residues in a polynucleotide, which includes alterations arising within a protein-encoding region of a gene as well as alterations in regions outside of a protein-encoding sequence, such as, but not limited to, regulatory or promoter sequences. A genetic alteration may be a mutation of any type. For instance, the mutation may constitute a point mutation, a frame-shift mutation, an insertion, or a deletion of part or all of a gene. In addition, in some embodiments of the modified microorganism, a portion of the microorganism genome has been replaced with a heterologous polynucleotide. In some embodiments, the mutations are naturally-occurring. In other embodiments, the mutations are the results of artificial selection pressure. In still other embodiments, the mutations in the microorganism genome are the result of genetic engineering.

The term "biosynthetic pathway", also referred to as "metabolic pathway", refers to a set of anabolic or catabolic biochemical reactions for converting one chemical species into another. Gene products belong to the same "metabolic pathway" if they, in parallel or in series, act on the same substrate, produce the same product, or act on or produce a metabolic intermediate (i.e., metabolite) between the same substrate and metabolite end product.

As used herein, the term "isobutanol producing metabolic pathway" refers to an enzyme pathway which produces isobutanol from pyruvate.

The term "heterologous" as used herein with reference to molecules and in particular enzymes and polynucleotides, indicates molecules that are expressed in an organism other than the organism from which they originated or are found in nature, independently of the level of expression that can be lower, equal or higher than the level of expression of the molecule in the native microorganism. The term "heterologous" is also used synonymously herein with the term "exogenous."

On the other hand, the term "native" or "endogenous" as used herein with reference to molecules, and in particular enzymes and polynucleotides, indicates molecules that are expressed in the organism in which they originated or are found in nature, independently of the level of expression that can be lower equal or higher than the level of expression of the molecule in the native microorganism. It is understood that expression of native enzymes or polynucleotides may be modified in recombinant microorganisms.

The term "feedstock" is defined as a raw material or mixture of raw materials supplied to a microorganism or fermentation process from which other products can be made. For example, a carbon source, such as biomass or the carbon compounds derived from biomass are a feedstock for a microorganism that produces a biofuel in a fermentation process. However, a feedstock may contain nutrients other than a carbon source.

The term "substrate" or "suitable substrate" refers to any substance or compound that is converted or meant to be converted into another compound by the action of an enzyme. The term includes not only a single compound, but also combinations of compounds, such as solutions, mixtures and other materials which contain at least one substrate, or derivatives thereof. Further, the term "substrate" encompasses not only compounds that provide a carbon source suitable for use as a starting material, such as any biomass derived sugar, but also intermediate and end product metabolites used in a pathway associated with a recombinant microorganism as described herein.

The term "C2-compound" as used as a carbon source for engineered yeast microorganisms with mutations in all pyruvate decarboxylase (PDC) genes resulting in a reduction of pyruvate decarboxylase activity of said genes refers to organic compounds comprised of two carbon atoms, including but not limited to ethanol and acetate.

The term "fermentation" or "fermentation process" is defined as a process in which a microorganism is cultivated in a culture medium containing raw materials, such as feedstock and nutrients, wherein the microorganism converts raw materials, such as a feedstock, into products.

The term "volumetric productivity" or "production rate" is defined as the amount of product formed per volume of medium per unit of time. Volumetric productivity is reported in gram per liter per hour (g/L/h).

The term "specific productivity" or "specific production rate" is defined as the amount of product formed per volume of medium per unit of time per amount of cells. Specific productivity is reported in gram or milligram per liter per hour per OD (g/L/h/OD).

The term "yield" is defined as the amount of product obtained per unit weight of raw material and may be expressed as g product per g substrate (g/g). Yield may be expressed as a percentage of the theoretical yield. "Theoretical yield" is defined as the maximum amount of product that can be generated per a given amount of substrate as dictated by the stoichiometry of the metabolic pathway used to make the product. For example, the theoretical yield for one typical conversion of glucose to isobutanol is 0.41 g/g. As such, a yield of isobutanol from glucose of 0.39 g/g would be expressed as 95% of theoretical or 95% theoretical yield.

The term "titer" is defined as the strength of a solution or the concentration of a substance in solution. For example, the titer of a biofuel in a fermentation broth is described as g of biofuel in solution per liter of fermentation broth (g/L).

"Aerobic conditions" are defined as conditions under which the oxygen concentration in the fermentation medium is sufficiently high for an aerobic or facultative anaerobic microorganism to use as a terminal electron acceptor.

In contrast, "anaerobic conditions" are defined as conditions under which the oxygen concentration in the fermentation medium is too low for the microorganism to use as a terminal electron acceptor. Anaerobic conditions may be achieved by sparging a fermentation medium with an inert gas such as nitrogen until oxygen is no longer available to the microorganism as a terminal electron acceptor. Alternatively, anaerobic conditions may be achieved by the microorganism consuming the available oxygen of the fermentation until oxygen is unavailable to the microorganism as a terminal electron acceptor.

"Aerobic metabolism" refers to a biochemical process in which oxygen is used as a terminal electron acceptor to make energy, typically in the form of ATP, from carbohydrates. Aerobic metabolism occurs e.g. via glycolysis and the TCA cycle, wherein a single glucose molecule is metabolized completely into carbon dioxide in the presence of oxygen.

In contrast, "anaerobic metabolism" refers to a biochemical process in which oxygen is not the final acceptor of electrons contained in NADH. Anaerobic metabolism can be divided into anaerobic respiration, in which compounds other than oxygen serve as the terminal electron acceptor, and substrate level phosphorylation, in which the electrons from NADH are utilized to generate a reduced product via a "fermentative pathway."

In "fermentative pathways", NAD(P)H donates its electrons to a molecule produced by the same metabolic pathway that produced the electrons carried in NAD(P)H. For example, in one of the fermentative pathways of certain yeast strains, NAD(P)H generated through glycolysis transfers its electrons to pyruvate, yielding ethanol. Fermentative pathways are usually active under anaerobic conditions but may also occur under aerobic conditions, under conditions where NADH is not fully oxidized via the respiratory chain. For example, above certain glucose concentrations, Crabtree-positive yeasts produce large amounts of ethanol under aerobic conditions.

The term "byproduct" means an undesired product related to the production of a biofuel or biofuel precursor. Byproducts are generally disposed as waste, adding cost to a production process.

The term "non-fermenting yeast" is a yeast species that fails to demonstrate an anaerobic metabolism in which the electrons from NADH are utilized to generate a reduced product via a fermentative pathway such as the production of ethanol and $CO_2$ from glucose. Non-fermentative yeast can be identified by the "Durham Tube Test" (J. A. Barnett, R. W. Payne, and D. Yarrow. 2000. Yeasts Characteristics and Identification. $3^{rd}$ edition. p. 28-29. Cambridge University Press, Cambridge, UK.) or by monitoring the production of fermentation productions such as ethanol and $CO_2$.

The term "polynucleotide" is used herein interchangeably with the term "nucleic acid" and refers to an organic polymer composed of two or more monomers including nucleotides, nucleosides or analogs thereof, including but not limited to single stranded or double stranded, sense or antisense deoxyribonucleic acid (DNA) of any length and, where appropriate, single stranded or double stranded, sense or antisense ribonucleic acid (RNA) of any length, including siRNA. The term "nucleotide" refers to any of several compounds that consist of a ribose or deoxyribose sugar joined to a purine or a pyrimidine base and to a phosphate group, and that are the basic structural units of nucleic acids. The term "nucleoside" refers to a compound (as guanosine or adenosine) that consists of a purine or pyrimidine base combined with deoxyribose or ribose and is found especially in nucleic acids. The term "nucleotide analog" or "nucleoside analog" refers, respectively, to a nucleotide or nucleoside in which one or more individual atoms have been replaced with a different atom or with a different functional group. Accordingly, the term polynucleotide includes nucleic acids of any length, DNA, RNA, analogs and fragments thereof. A polynucleotide of three or more nucleotides is also called nucleotidic oligomer or oligonucleotide.

It is understood that the polynucleotides described herein include "genes" and that the nucleic acid molecules described herein include "vectors" or "plasmids." Accordingly, the term "gene", also called a "structural gene" refers to a polynucleotide that codes for a particular sequence of amino acids, which comprise all or part of one or more proteins or enzymes, and may include regulatory (non-transcribed) DNA sequences, such as promoter sequences, which determine for example the conditions under which the gene is expressed. The transcribed region of the gene may include untranslated regions, including introns, 5'-untranslated region (UTR), and 3'-UTR, as well as the coding sequence.

The term "operon" refers to two or more genes which are transcribed as a single transcriptional unit from a common promoter. In some embodiments, the genes comprising the operon are contiguous genes. It is understood that transcription of an entire operon can be modified (i.e., increased, decreased, or eliminated) by modifying the common promoter. Alternatively, any gene or combination of genes in an operon can be modified to alter the function or activity of the encoded polypeptide. The modification can result in an increase in the activity of the encoded polypeptide. Further, the modification can impart new activities on the encoded polypeptide. Exemplary new activities include the use of alternative substrates and/or the ability to function in alternative environmental conditions.

A "vector" is any means by which a nucleic acid can be propagated and/or transferred between organisms, cells, or cellular components. Vectors include viruses, bacteriophage, pro-viruses, plasmids, phagemids, transposons, and artificial chromosomes such as YACs (yeast artificial chromosomes), BACs (bacterial artificial chromosomes), and PLACs (plant artificial chromosomes), and the like, that are "episomes," that is, that replicate autonomously or can integrate into a chromosome of a host cell. A vector can also be a naked RNA polynucleotide, a naked DNA polynucleotide, a polynucleotide composed of both DNA and RNA within the same strand, a poly-lysine—conjugated DNA or RNA, a peptide-conjugated DNA or RNA, a liposome-conjugated DNA, or the like, that are not episomal in nature, or it can be an organism which comprises one or more of the above polynucleotide constructs such as an *agrobacterium* or a bacterium.

"Transformation" refers to the process by which a vector is introduced into a host cell. Transformation (or transduction, or transfection), can be achieved by any one of a number of means including chemical transformation (e.g. lithium acetate transformation), electroporation, microinjection, biolistics (or particle bombardment-mediated delivery), or *agrobacterium* mediated transformation.

The term "enzyme" as used herein refers to any substance that catalyzes or promotes one or more chemical or biochemical reactions, which usually includes enzymes totally or partially composed of a polypeptide, but can include enzymes composed of a different molecule including polynucleotides.

The term "protein," "peptide," or "polypeptide" as used herein indicates an organic polymer composed of two or more amino acidic monomers and/or analogs thereof. As used herein, the term "amino acid" or "amino acidic monomer" refers to any natural and/or synthetic amino acids including glycine and both D or L optical isomers. The term "amino acid analog" refers to an amino acid in which one or more individual atoms have been replaced, either with a different atom, or with a different functional group. Accordingly, the term polypeptide includes amino acidic polymer of any length including full length proteins, and peptides as well as analogs and fragments thereof. A polypeptide of three or more amino acids is also called a protein oligomer or oligopeptide The term "homolog," used with respect to an original enzyme or gene of a first family or species, refers to distinct enzymes or genes of a second family or species which are determined by functional, structural or genomic analyses to be an enzyme or gene of the second family or species which corresponds to the original enzyme or gene of the first family or species. Most often, homologs will have functional, structural or genomic similarities. Techniques are known by which homologs of an enzyme or gene can readily be cloned using genetic probes and PCR. Identity of cloned sequences as homolog can be confirmed using functional assays and/or by genomic mapping of the genes.

A protein has "homology" or is "homologous" to a second protein if the amino acid sequence encoded by a gene has a similar amino acid sequence to that of the second gene. Alternatively, a protein has homology to a second protein if the two proteins have "similar" amino acid sequences. (Thus, the term "homologous proteins" is defined to mean that the two proteins have similar amino acid sequences).

The term "analog" or "analogous" refers to nucleic acid or protein sequences or protein structures that are related to one another in function only and are not from common descent or do not share a common ancestral sequence. Analogs may differ in sequence but may share a similar structure, due to convergent evolution. For example, two enzymes are analogs or analogous if the enzymes catalyze the same reaction of conversion of a substrate to a product, are unrelated in sequence, and irrespective of whether the two enzymes are related in structure.

Enhancing DHAD Activity by Altering Aft1/Aft2 Activity and/or Expression

The present inventors have found that altering the expression of the AFT1 and/or AFT2 genes of *S. cerevisiae* surprisingly increases DHAD activity and contributes to increased isobutanol titers, productivity, and yield in strains comprising DHAD as part of an isobutanol-producing metabolic pathway. The observed increases in DHAD activity resulting from the increased expression of AFT1 and/or AFT2 therefore has broad applicability to any DHAD-requiring biosynthetic pathway, as DHAD activity is often a rate-limiting component of such pathways.

Accordingly, one aspect of the invention is directed to a recombinant microorganism comprising a DHAD-requiring biosynthetic pathway, wherein said microorganism is engineered to overexpress one or more polynucleotides encoding one or more Aft proteins or homologs thereof.

As used herein, a "DHAD-requiring biosynthetic pathway" refers to any metabolic pathway which utilizes DHAD to convert 2,3-dihydroxyisovalerate to α-ketoisovalerate or 2,3-dihydroxy-3-methylvalerate to 2-keto-3-methylvalerate. Examples of DHAD-requiring biosynthetic pathways include, but are not limited to, isobutanol, 3-methyl-1-butanol, 2-methyl-1-butanol, valine, isoleucine, leucine, and pantothenic acid (vitamin B5) metabolic pathways. The metabolic pathway may naturally occur in a microorganism (e.g., a natural pathway for the production of valine) or arise from the introduction of one or more heterologous polynucleotides through genetic engineering. In one embodiment, the recombinant microorganisms expressing the DHAD-requiring biosynthetic pathway are yeast cells. Engineered biosynthetic pathways for synthesis of isobutanol are described in commonly owned and co-pending applications U.S. Ser. No. 12/343,375 (published as US 2009/0226991), U.S. Ser. No. 12/696,645, U.S. Ser. No. 12/610,784 (published as US 2010/0143997), U.S. Ser. No. 12/855,276, PCT/US09/62952 (published as WO/2010/051527), and PCT/US09/69390 (published as WO/2010/075504), all of which are herein incorporated by reference in their entireties for all purposes. Additional DHAD-requiring biosynthetic pathways have been described for the synthesis of valine, leucine, and isoleucine (See, e.g., WO/2001/021772, and McCourt et al., 2006, *Amino Acids* 31: 173-210), pantothenic acid (See, e.g., WO/2001/021772), 3-methyl-1-butanol (See, e.g., WO/2008/098227, Atsumi et al., 2008, *Nature* 451: 86-89, and Connor et al., 2008, *Appl. Environ. Microbiol.* 74: 5769-5775), and 2-methyl-1-butanol (See, e.g., WO/2008/098227, WO/2009/076480, and Atsumi et al., 2008, Nature 451: 86-89).

As used herein, the terms "DHAD" or "DHAD enzyme" or "dihydroxyacid dehydratase" are used interchangeably herein to refer to an enzyme that catalyzes the conversion of 2,3-dihydroxyisovalerate to ketoisovalerate and/or the conversion of 2,3-dihydroxy-3-methylvalerate to 2-keto-3-methylvalerate. DHAD sequences are available from a vast array of microorganisms, including, but not limited to, *L. lactis*, *E. coli*, *S. cerevisiae*, *B. subtilis*, *Streptococcus pneumoniae*, and *Streptococcus mutans*. A representative list of DHAD enzymes that can benefit from the methods described herein, such as the increased expression of AFT1 and/or AFT2 or homologs thereof, include, but are not limited to those, disclosed in 2010/0081154, as well as those disclosed in commonly owned and co-pending U.S. patent application Ser. Nos. 12/855,276 and 61/407,815. Such DHAD enzymes may be cytosolically localized or mitochondrially localized. A representative listing of DHAD enzymes exhibiting cytosolic localization and activity are disclosed in commonly owned and co-pending U.S. patent application Ser. No. 12/855,276.

Without being bound by any theory, it is believed that altered expression of an AFT gene (e.g. the AFT1 and/or AFT2 genes) enhances cellular iron availability, which leads to an improvement in the activity of the iron-sulfur (FeS) cluster—. containing protein, DHAD. The observation that increased expression of the AFT genes improves DHAD activity is surprising, particularly in light of recently published findings by Ihrig et al. (2010, *Eukaryotic Cell* 9: 460-471). Notably, Ihrig of al. observed that the increased expression of Aft1 in *S. cerevisiae* had little to no effect on the activity of another FeS cluster-containing protein, Leu1 (isopropylmalate isomerase of the leucine biosynthesis pathway). In contrast to observations made by Ihrig of al. with respect to the FeS protein, Leu1, the present inventors unexpectedly observed that increased expression of Aft1 and/or Aft2 resulted in a significant increase in the activity of DHAD, also an iron-sulfur (FeS) cluster-containing protein. Moreover, in strains comprising DHAD as part of an isobutanol-producing metabolic pathway, the increased expression of Aft1 produced significant increases in isobutanol titer, productivity, and yield.

In *S. cerevisiae*, AFT1 and AFT2 encode for the transcription factors, Aft1 and Aft2 ("activator of ferrous transport"), respectively. It is hypothesized that Aft1 and Aft2 activate gene expression when iron is scarce in wild-type *S. cerevisiae*. Consequently, strains lacking both Aft1 and Aft2 exhibit reduced expression of the iron regulon. As with many other paralogous genes, AFT1 and AFT2 code for proteins that have significant regions of identity and overlapping functions. The DNA-binding domain of each protein is in a highly conserved N-terminal region, and a conserved cysteine-tophenylalanine mutation in either protein generates a factor that activates the high expression of the iron regulon irrespective of iron concentrations.

In yeast, homeostatic regulation of iron uptake occurs (Eide et al., 1992, *J. Biol Chem.* 267: 20774-81). Iron deprivation induces activity of a high affinity iron uptake system. This induction is mediated by increased transcript levels for genes involved in the iron uptake system, and AFT1 is hypothesized to play a critical role in this process (Yamaguchi-Iwai of al., 1995, *The EMBO Journal* 14: 1231-9). Yamaguchi-lwai of al. observed that mutant strains lacking AFT1, due to gene deletion, are unable to induce the high-affinity iron uptake system. On the other hand, mutant strains carrying the AFT1$^{UP}$ allele exhibit a gain-of-function phenotype in which iron uptake cannot be repressed by available iron in the environment. The AFT1$^{UP}$ and AFT2$^{UP}$ alleles described above act as gain of function point mutations. AFT1$^{UP}$ is due to the mutation Cys$^{291}$Phe (Rutherford et al., 2005, *Journal of Biological Chemistry* 281: 10135-40). AFT2$^{UP}$ is due to the mutation Cys$^{187}$Phe (Rutherford et al., 2001, *PNAS* 98: 14322-27).

There are clear phenotypic differences in strains that separately lack AFT1 or AFT2. An aft1 null strain exhibits low ferrous iron uptake and grows poorly under low-iron conditions or on a respiratory carbon source. No phenotype has been attributed to an aft2 null strain. An aft1 aft2 double null strain is, however, more sensitive to low-iron growth than a single aft1 null strain, which is consistent with the functional similarity of these factors. The partial redundancy of these factors allows AFT2 to complement an aft1 null strain when it is overexpressed from a plasmid. The properties of Aft1 and Aft2 that distinguish them from each other have not been fully elucidated. Both factors mediate gene regulation via an iron-responsive element that contains the core sequence 5'-CACCC-3'. Without being bound to any theory, it is likely that sequences adjacent to this element influence the ability of each factor to mediate regulation via a particular iron-responsive element. The differential regulation of individual genes by Aft1 and Aft2 results in each factor generating a distinct global transcriptional profile (Table 1) (Rutherford et al., 2004, *Eukaryotic Cell* 3: 1-13; Conde e Silva at al., 2009, *Genetics* 183: 93-106).

TABLE 1

Genes Regulated by Metal-Responsive Transcription Factors.

| Transcription Factor | Description | Gene Name(s) |
|---|---|---|
| Aft1 | Transporters | FET4, FET5, FTR1, FTH1, SMF3, MRS3, MRS4, CCC2, COT1 |
| | Cu chaperone | ATX1 |
| | Ferroxidase | FET3, FET5 |
| | Metalloreductases | FRE1, FRE2, FRE3, FRE4, FRE5, FRE6 |
| | Cell wall proteins | FIT1, FIT2, FIT3 |
| | Siderophore transport | ARN1, ARN2, ARN3, ARN4 |
| | Fe—S biosynthesis | ISU1, ISU2 |
| | Other | TIS11, HMX1, AKR1, PCL5, YOR387c, YHL035c, YMR034c, ICY2, PRY1, YDL124w, CTH1, CTH2, |
| Aft2 | Transporters | SMF3, MRS4, FTR1, COT1 |
| | Cu chaperone | ATX1 |
| | Ferroxidase | FET3, FET5 |
| | Metalloreductases | FRE1 |
| | Cell wall proteins | FIT1, FIT3, FIT2 |
| | Fe—S biosynthesis | ISU1 |
| | Other | BNA2, ECM4, LAP4, TIS11, YOL083w, YGR146c, YHL035c |

In *S. cerevisiae*, the Aft1 regulon consists of many genes that are involved in the acquisition, compartmentalization, and utilization of iron. These include genes involved in iron uptake (FET3, FTR1, and FRE1, FRE2), siderophore uptake (ARN1-4 and FIT1-3), iron transport across the vacuole membrane (FTH1), and iron-sulfur cluster formation (ISU1 and ISU2). Aft1 binds to a conserved promoter sequence in an iron-dependent manner and activates transcription under low-iron conditions. The Aft2 regulator controls the expression of several distinct genes (Table 2) (Rutherford et al., 2004, *Eukaryotic Ce*l13: 1-13). The initial step in iron acquisition requires reduction of ferric iron chelates in the environment by externally directed reductases encoded by the FRE1 and FRE2 genes, thereby generating the ferrous iron substrate for the transport process (Dancis at al., 1992, *PNAS* 89: 3869-73; Georgatsou and Alexandraki, 1994, *Mol. Cell. Biol.* 14: 3065-73). FET3 encodes a multi-copper oxidase (Askwith et al., 1994, *Cell* 76: 403-10; De Silva of al., 1995, *J. Biol. Chem.* 270: 1098-1101) that forms a molecular complex with the iron permease encoded by FTR1. This complex, located in the yeast plasma membrane, mediates the high-affinity transport of iron into the cell (Stearman et al., 1996, *Science* 271: 1552-7). AFT genes may be found in yeast strains other than *S. cerevisiae*. For example, in *K. lactis*, a homolog of the *S. cerevisiae* AFT1 has been found and designated Kl_AFT (Conde e Silva at al., 2009, *Genetics* 183: 93-106). In this fungus, Kl_Aft has been found to activate transcription of genes regulated by Aft1 in *S. cerevisiae*. Thus, altering the regulation, activity, and/or expression of AFT homologs in fungal strains other than *S. cerevisiae*, Is also within the scope of this invention. A person skilled in the art will be able to utilize publicly available sequences to construct relevant recombinant microorganisms with altered expression of AFT homologs. A listing of a representative number of AFT homologs known in the art and useful in the construction of recombinant microorganisms engineered for increased DHAD activity are listed Table 2. One skilled in the art, equipped with this disclosure, will appreciate other suitable homologs for the generation of recombinant microorganisms with increased DHAD activity. Sequences of AFT genes found in sub-species or variants of a given species may not be identical (See, e.g., >98% identity amongst *S. cerevisiae* AFT1 genes of SEQ ID NOs: 1, 208, 210, 212, 214, 216, 218, 220, 222, and 224). While it is preferred to overexpress an AFT gene native to the subspecies *or* variant, AFT genes may be interchangeably expressed across subspecies *or* variants of the same species.

TABLE 2

Representative Aft Homologs of Yeast Origin

| Species Origin (Gene Name) | Nucleic Acid Sequence (SEQ ID NO) | Amino Acid Sequence (SEQ ID NO) |
|---|---|---|
| *Saccharomyces cerevisiae* S288c (AFT1) | 1 | 2 |
| *Saccharomyces cerevisiae* S288c (AFT2) | 3 | 4 |
| *Candida glabrata* (AFT1) | 5 | 6 |
| *Candida glabrata* (AFT2) | 7 | 8 |
| *Zygosaccharomyces rouxii* (AFT) | 9 | 10 |
| *Ashbya gossypii* (AFT) | 11 | 12 |
| *Kluyveromyces lactis* (AFT) | 13 | 14 |
| *Vanderwaltozyma polyspora* (AFT) | 15 | 16 |
| *Lachancea thermotolerans* (AFT) | 17 | 18 |
| *Debaromyces hanseii* (AFT) | 19 | 20 |
| *Saccharomyces bayanus** | 21 | 22 |
| *Saccharomyces castelli** | 23 | 24 |
| *Kluyveromyces waltii** | 25 | 26 |

TABLE 2-continued

Representative Aft Homologs of Yeast Origin

| Species Origin (Gene Name) | Nucleic Acid Sequence (SEQ ID NO) | Amino Acid Sequence (SEQ ID NO) |
|---|---|---|
| *Saccharomyces kluyveri*\* | 27 | 28 |
| *Kluyveromyces marxianus* | 29 | 30 |
| *Issatchenkia orientalis* (AFT1-1) | 31 | 32 |
| *Issatchenkia orientalis* (AFT1-2) | 33 | 34 |
| *Saccharomyces bayanus* (AFT2) | 35 | 36 |
| *Saccharomyces castelli* (AFT2) | 37 | 38 |
| *S. cerevisiae* W303 (AFT1) | 208 | 209 |
| *S. cerevisiae* DBVPG1106 (AFT1) | 210 | 211 |
| *S. cerevisiae* NCYC361 (AFT1) | 212 | 213 |
| *S. cerevisiae* Y55 (AFT1) | 214 | 215 |
| *S. cerevisiae* YJM981 (AFT1) | 216 | 217 |
| *S. cerevisiae* RM11_1A (AFT1) | 218 | 219 |
| *S. cerevisiae* UWOPS87_2421 (AFT1) | 220 | 221 |
| *S. cerevisiae* SK1 (AFT1) | 222 | 223 |
| *S. cerevisiae* YPS606 (AFT1) | 224 | 225 |

\*Byrne K. P., Wolfe, K. H. (2005) The Yeast Gene Order Browser: combining curated homology and syntenic context reveals gene fate in polyploid species. Genome Research, 15(10): 1456-61

Without being bound by any theory, it is believed that increasing the expression of the gene AFT1 or a homolog thereof will modulate the amount and availability of iron in the host cell. Since Aft1 activates the expression of target genes in response to changes in iron availability, overexpression of AFT1 increases the machinery to import more iron into the cytosol and/or mitochondria. A person skilled in the art, equipped with this disclosure, will appreciate suitable methods for increasing the expression (i.e. overexpressing) AFT1. For instance, in one embodiment, AFT1 or homolog thereof may be overexpressed from a plasmid. In another embodiment, one or more copies of the AFT1 gene or a homolog thereof is Inserted into the chromosome under the control of a constitutive promoter. In addition, a skilled person in the art, equipped with this disclosure, will recognize that the amount of AFT1 overexpressed may vary from one yeast to the next. For example, the optimal level of overexpression may be one, two, three, four or more copies in a given yeast.

In additional embodiments, the native Aft1 or homolog thereof may be replaced with a mutant version that is constitutively active. In one embodiment, the native Aft1 is replaced with a mutant version that comprises a modification or mutation at a position corresponding to amino acid cysteine 291 of the *S. cerevisiae* Aft1 (SEQ ID NO: 2). In an exemplary embodiment, the cysteine 291 residue of the native *S. cerevisiae* Aft1 (SEQ ID NO: 2) or homolog thereof is replaced with a phenylalanine residue.

As will be understood by one of ordinary skill in the art, modified Aft1 proteins and homologs thereof may be obtained by recombinant or genetic engineering techniques that are routine and well-known in the art. For example, mutant Aft1 proteins and homologs thereof, can be obtained by mutating the gene or genes encoding Aft1 or the homologs of interest by site-directed mutagenesis. Such mutations may include point mutations, deletion mutations and insertional mutations. For example, one or more point mutations (e.g., substitution of one or more amino acids with one or more different amino acids) may be used to construct mutant Aft1 proteins of the invention. The corresponding cysteine position of Aft1 homologs may be readily identified by one skilled in the art. Thus, given the defined region and the examples described in the present application, one with skill in the art can make one or a number of modifications which would result in the constitutive expression of Aft1.

Without being bound by any theory, it is believed that increasing the expression of the gene AFT2 or a homolog thereof will modulate the amount and availability of iron in the host cell. AFT2 overexpression is predicted to result in increased expression of the machinery to import more iron into the cytosol and/or mitochondria. A person skilled in the art, equipped with this disclosure, will appreciate suitable methods for increasing the expression (i.e. overexpression) of AFT2. For instance, in one embodiment, AFT2 or homolog thereof may be overexpressed from a plasmid. In another embodiment, one or more copies of the AFT2 gene or a homolog thereof is inserted into the chromosome under the control of a constitutive promoter. In addition, a skilled person in the art, equipped with this disclosure, will recognize that the amount of AFT2 overexpressed may vary from one yeast to the next. For example, the optimal level of overexpression may be one, two, three, four or more copies in a given yeast. Moreover, the expression level may be tuned by using a promoter that achieves the optimal expression level in a given yeast In another embodiment, the native Aft2 or homolog thereof may be replaced with a mutant version that is constitutively active. In one embodiment, the native Aft2 is replaced with a mutant version that comprises a modification or mutation at a position corresponding to amino acid cysteine 187 of the *S. cerevisiae* Aft2 (SEQ ID NO: 4). In an exemplary embodiment, the cysteine 187 residue of the native *S. cerevisiae* Aft2 (SEQ ID NO: 4) or homolog thereof is replaced with a phenylalanine residue.

As will be understood by one of ordinary skill in the art, modified Aft2 proteins and homologs thereof may be obtained by recombinant or genetic engineering techniques that are routine and well-known in the art. For example, mutant Aft2 proteins and homologs thereof, can be obtained by mutating the gene or genes encoding Aft2 or the homologs of interest by site-directed. Such mutations may include point mutations, deletion mutations and insertional mutations. For example, one or more point mutations (e.g., substitution of one or more amino acids with one or more different amino acids) may be used to construct mutant Aft2 proteins of the invention. The corresponding cysteine position of Aft2 homologs may be readily identified by one skilled in the art. Thus, given the defined region and the examples described in the present application, one with skill in the art can make one or a number of modifications which would result in the constitutive expression of Aft2.

In various exemplary embodiments, increasing the expression of both AFT1 and/or AFT2 will increase DHAD activity and the production of beneficial metabolites from DHAD-requiring biosynthetic pathways.

Embodiments in which the regulation, activity, and/or expression of AFT1 and/or AFT2 are altered can also be combined with increases in the extracellular iron concentration to provide increased iron in the cytosol and/or mitochondria of the cell. Increase in iron in either the cytosol or the mitochondria by this method appears to make iron more available for the FeS cluster-containing protein, DHAD. Without being bound by any theory, it is believed that such an increase in iron leads to a corresponding increase in DHAD activity.

As described herein, the increased activity of DHAD in a recombinant microorganism is a favorable characteristic for the production of beneficial metabolites including isobutanol, 3-methyl-1-butanol, 2-methyl-1-butanol, valine, isoleucine, leucine, and pantothenic acid derived from DHAD-requiring biosynthetic pathways. Without being bound by any theory, it is believed that the increase in DHAD activity as observed by the present inventors results from enhanced cellular iron levels as mediated by the altered regulation, expression, and/or activity of AFT1 and/or AFT2. Thus, in various embodiments described herein, the present invention provides recombinant microorganisms with increased DHAD activity as a result of alterations in AFT1 and/or AFT2 regulation, expression, and/or activity. In one embodiment, the alteration in AFT1 and/or AFT2 regulation, expression, and/or activity increases the activity of a cytosolically-localized DHAD. In another embodiment, the alteration in AFT1 and/or AFT2 regulation, expression, and/or activity increases the activity of a mitochondrially-localized DHAD.

While particularly useful for the biosynthesis of isobutanol, the altered regulation, expression, and/or activity of AFT1 and/or AFT2 is also beneficial to any other fermentation process in which increased DHAD activity is desirable, including, but not limited to, the biosynthesis of isoleucine, valine, leucine, pantothenic acid (vitamin B5), 2-methyl-1-butanol, and 3-methyl-1-butanol.

As described herein, the present inventors have observed increased isobutanol titers, productivity, and yields in recombinant microorganisms exhibiting increased expression of AFT1 and/or AFT2. Without being bound by any theory, it is believed that the increases in isobutanol titer, productivity, and yield are due to the observed increases in DHAD activity. Thus, in one embodiment, the present invention provides a recombinant microorganism for producing isobutanol, wherein said recombinant microorganism comprises an isobutanol producing metabolic pathway, and wherein the expression of AFT1 or a homolog thereof is increased. In another embodiment, the present invention provides a recombinant microorganism for producing isobutanol, wherein said recombinant microorganism comprises an isobutanol producing metabolic pathway, and wherein the expression of AFT2 or a homolog thereof is increased. In yet another embodiment, the present invention provides a recombinant microorganism for producing isobutanol, wherein said recombinant microorganism comprises an isobutanol producing metabolic pathway, and wherein the expression of AFT1 and AFT2 or homologs thereof is increased.

In alternative embodiments, nucleic acids having a homology to AFT1 and/or AFT2 of at least about 50%, of at least about 60%, of at least about 70%, at least about 80%, or at least about 90% similarity can be used for a similar purpose.

In one embodiment, the present invention provides a recombinant microorganism for producing isobutanol, wherein said recombinant microorganism comprises an isobutanol producing metabolic pathway, and wherein the activity of Aft1 or a homolog thereof is increased. In another embodiment, the present invention provides a recombinant microorganism for producing isobutanol, wherein said recombinant microorganism comprises an isobutanol producing metabolic pathway, and wherein the activity of Aft2 or a homolog thereof is increased. In yet another embodiment, the present invention provides a recombinant microorganism for producing isobutanol, wherein said recombinant microorganism comprises an isobutanol producing metabolic pathway, and wherein the activity of Aft1 and Aft2 or homologs thereof is increased.

In alternative embodiments, proteins having a homology to Aft1 and/or Aft2 of at least about 50%, of at least about 60%, of at least about 70%, at least about 80%, or at least about 90% similarity can be used for a similar purpose.

In one embodiment, the isobutanol producing metabolic pathway comprises at least one exogenous gene that catalyzes a step in the conversion of pyruvate to isobutanol. In another embodiment, the isobutanol producing metabolic pathway comprises at least two exogenous genes that catalyze steps in the conversion of pyruvate to isobutanol. In yet another embodiment, the isobutanol producing metabolic pathway comprises at least three exogenous genes that catalyze steps in the conversion of pyruvate to isobutanol. In yet another embodiment, the isobutanol producing metabolic pathway comprises at least four exogenous genes that catalyze steps in the conversion of pyruvate to isobutanol. In yet another embodiment, the isobutanol producing metabolic pathway comprises at five exogenous genes that catalyze steps in the conversion of pyruvate to isobutanol.

In one embodiment, one or more of the isobutanol pathway genes encodes an enzyme that is localized to the cytosol. In one embodiment, the recombinant microorganisms comprise an isobutanol producing metabolic pathway with at least one isobutanol pathway enzyme localized in the cytosol. In another embodiment, the recombinant microorganisms comprise an isobutanol producing metabolic pathway with at least two isobutanol pathway enzymes localized in the cytosol. In yet another embodiment, the recombinant microorganisms comprise an isobutanol producing metabolic pathway with at least three isobutanol pathway enzymes localized in the cytosol. In yet another embodiment, the recombinant microorganisms comprise an isobutanol producing metabolic pathway with at least four isobutanol pathway enzymes localized in the cytosol. In an exemplary embodiment, the recombinant microorganisms comprise an isobutanol producing metabolic pathway with five isobutanol pathway enzymes localized in the cytosol. In a further exemplary embodiment, at least one of the pathway enzymes localized to the cytosol is a cytosolically active DHAD enzyme as disclosed herein.

In various embodiments described herein, the isobutanol pathway genes encodes enzyme(s) selected from the group consisting of acetolactate synthase (ALS), ketol-acid reductoisomerase (KAR1), dihydroxyacid dehydratase (DHAD), 2-keto-acid decarboxylase (KIVD), and alcohol dehydrogenase (ADH).

As described above, the transcription factors Aft1 and Aft2 regulate genes involved in the acquisition, compartmentalization, and utilization of iron. Thus, In additional aspects, the present invention provides methods of increasing DHAD activity and the production of beneficial metabolites produced from DHAD-requiring biosynthetic pathways as a result of alterations in the regulation, expression, and/or activity of genes regulated by Aft1 and Aft2. In one embodiment, the gene(s) regulated by Aft1 and Aft2 is selected from the group consisting of FET3, FET4, FET5, FTR1, FTH1, SMF3, MRS4, CCC2, COT1, ATX1, FRE1, FRE2, FRE3, FRE4, FRE5, FRE6, FIT1, FIT2, FIT3, ARN1, ARN2, ARN3, ARN4, ISU1, ISU2, TIS11, HMX1, AKR1, PCL5, YOR387C, YHL035C, YMR034C, ICY2, PRY1, YDL124W, BNA2, ECM4, LAP4, YOL083W, YGR146C, 8105, YDR271C, OYE3, CTH1, CTH2, MRS3, MRS4, HSP26, YAP2, VMR1, ECL1, OSW1, NFT1, ARA2, TAF1/TAF130/TAF145, YOR225W, YKR104W, YBR012C, and YMR041C or a homolog thereof. While particularly useful for the biosynthesis of isobutanol, the altered regulation, expression, and/or activity of genes regulated by Aft1 and Aft2 is also beneficial to any other fermentation process in which increased DHAD activity is desirable, including, but not limited to, the biosynthesis of isoleucine, valine, leucine, pantothenic acid (vitamin B5), 1-butanol, 2-methyl-1-butanol, and 3-methyl-1-butanol.

In one embodiment, all genes demonstrated to increase DHAD activity and/or the production of a metabolite from a DHAD-requiring biosynthetic pathway are overexpressed. Where none of the AFT regulon genes expressed alone are effective in increasing DHAD activity and/or the production of a metabolite from a DHAD-requiring biosynthetic pathway, then 1, 2, 3, 4, 5, or more of the genes in the AFT regulon are overexpressed together.

As described herein, the present inventors have observed increased isobutanol titers, productivity, and yields in recombinant microorganisms exhibiting increased expression of the transcription factors AFT1 and/or AFT2, which regulate the expression of genes involved in the acquisition, compartmentalization, and utilization of iron. Thus, in one embodiment, the present invention provides a recombinant microorganism for producing isobutanol, wherein said recombinant microorganism comprises an isobutanol producing metabolic pathway, and wherein the expression and/or activity of one or more genes selected from the group consisting of FET3, FET4, FET5, FTR1, FTH1, SMF3, MRS4, CCC2, COT1, ATX1, FRE1, FRE2, FRE3, FRE4, FRE5, FREE, FIT1, FIT2, FIT3, ARN1, ARN2, ARN3, ARN4, ISU1, ISU2, TIS11, HMX1, AKR1, PCL5, YOR387C, YHL035C, YMR034C, ICY2, PRY1, YDL124W, BNA2, ECM4, LAP4, YOL083W, YGR146C, 8105, YDR271C, OYE3, CTH1, CTH2, MRS3, MRS4, HSP26, YAP2, VMR1, ECL1, OSW1, NFT1, ARA2, TAF1/TAF130/TAF145, YOR225W, YKR104W, YBR012C, and YMR041C or a homolog thereof is increased.

Enhancing DHAD Activity by Increased GRX3/GRX4 Activity and/or Expression

As described herein, increasing the expression of the genes GRX3 and/or GRX4 will generally modulate the amount and availability of iron in the yeast cytosol or mitochondria. Accordingly, one aspect of the invention is directed to a recombinant microorganism comprising a DHAD-requiring biosynthetic pathway, wherein said microorganism has been engineered to overexpress a polynucleotide encoding Grx3 and/or Grx4 or a homolog thereof. In one embodiment, the polynucleotide encoding the Grx protein or homolog thereof is native to the recombinant microorganism. In another embodiment, the polynucleotide encoding the Grx protein or homolog thereof is heterologous to the recombinant microorganism.

Grx3 and Grx4 are monothiol glutaredoxins that have been shown to be involved in cellular Fe content modulation and delivery in yeast. Glutaredoxins are glutathione-dependent thiol-disulfide oxidoreductases that function in maintaining the cellular redox homeostasis. *S. cerevisiae* has two dithiol glutaredoxins (Grx1 and Grx2) and three monothiol glutaredoxins (Grx3, Grx4, and Grx5). The monothiol glutaredoxins are believed to reduce mixed disulfides formed between a protein and glutathione in a process known as deglutathionylation. In contrast, dithiol glutaredoxins can participate in deglutathionylation as well as in the direct reduction of disulfides. Grx5, the most studied monothiol glutaredoxin, is localized to the mitochondrial matrix, where it participates in the maturation of Fe—S clusters. Grx3 and Grx4 are predominantly localized to the nucleus. These proteins can substitute for Grx5 when overexpressed and targeted to the mitochondrial matrix; no information on their natural function has been reported. In addition to the reported interaction between Grx3 and Aft1, iron inhibition of Aft1 requires glutathione. It has been shown that iron sensing is dependent on the presence of the redundant Grx3 and Grx4 proteins. One report indicated that removal of both Grx3 and Grx4 resulted in constitutive expression of the genes regulated by Aft1/Aft2. This result suggested that the cells accumulated Fe at levels greater than normal.

In one embodiment, Grx3 is overexpressed from a plasmid or by inserting multiple copies of the gene into the chromosome under the control of a constitutive promoter. In another embodiment, Grx4 is overexpressed from a plasmid or by inserting multiple copies of the gene into the chromosome under the control of a constitutive promoter. In another embodiment, Grx3 and Grx4 are overexpressed from a plasmid or by inserting multiple copies of the gene into the chromosome under the control of a constitutive promoter. In another embodiment, Grx3, Grx4, or Grx3 and Grx4 are deleted or attenuated. In another embodiment, Grx3 and Aft1 are overexpressed from a plasmid or by inserting multiple copies of the gene into the chromosome under the control of a constitutive promoter. In another embodiment, Grx4 and Aft1 are overexpressed from a plasmid or by inserting multiple copies of the gene into the chromosome under the control of a constitutive promoter. In another embodiment, Grx3 and Aft2 are overexpressed from a plasmid or by inserting multiple copies of the gene into the chromosome under the control of a constitutive promoter. In another embodiment, Grx4 and Aft2 are overexpressed from a plasmid or by inserting multiple copies of the gene into the chromosome under the control of a constitutive promoter. These embodiments can also be combined with increases in the extracellular iron concentration to provide increased iron in the cytosol or mitochondria of the cell. One or both of: Aft1, Aft2 is overexpressed either alone or in combination with: Grx3 or Grx4. Such overexpression can be accomplished by plasmid or by inserting multiple copies of the gene into the chromosome under the control of a constitutive promoter.

As described herein, the increased activity of DHAD in a recombinant microorganism is a favorable characteristic for the production of beneficial metabolites including isobutanol, 3-methyl-1-butanol, 2-methyl-1-butanol, valine, isoleucine, leucine, and pantothenic acid from DHAD-requiring metabolic pathways. Thus, in various embodiments described herein, the present invention provides recombinant microorganisms with increased DHAD activity as a result of alterations in GRX3 and/or GRX4 regulation, expression, and/or activity. In one embodiment, the alteration in GRX3 and/or GRX4 regulation, expression, and/or activity increases the activity of a cytosolically-localized DHAD. In another embodiment, the alteration in GRX3 and/or GRX4 regulation, expression, and/or activity increases the activity of a mitochondrially-localized DHAD.

While particularly useful for the biosynthesis of isobutanol, the altered regulation, expression, and/or activity of GRX3 and/or GRX4 is also beneficial to any other fermentation process in which increased DHAD activity is desirable, including, but not limited to, the biosynthesis of isoleucine, valine, leucine, pantothenic acid (vitamin B5), 1-butanol, 2-methyl-1-butanol, and 3-methyl-1-butanol.

In one embodiment, the present invention provides a recombinant microorganism for producing isobutanol, wherein said recombinant microorganism comprises an isobutanol producing metabolic pathway, and wherein the expression of GRX3 or a homolog thereof is increased. In another embodiment, the present invention provides a recombinant microorganism for producing isobutanol, wherein said recombinant microorganism comprises an isobutanol producing metabolic pathway, and wherein the expression of GRX4 or a homolog thereof is increased. In yet another embodiment, the present invention provides a recombinant microorganism for producing isobutanol, wherein said recombinant microorganism comprises an isobutanol producing metabolic pathway, and wherein the expression of GRX3 and GRX4 or homologs thereof is increased.

In alternative embodiments, nucleic acids having a homology to GRX3 and/or GRX4 of at least about 50%, of at least about 60%, of at least about 70%, at least about 80%, or at least about 90% similarity can be used for a similar purpose.

In one embodiment, the present invention provides a recombinant microorganism for producing isobutanol, wherein said recombinant microorganism comprises an isobutanol producing metabolic pathway, and wherein the activity of Grx3 or a homolog thereof is increased. In another embodiment, the present invention provides a recombinant microorganism for producing isobutanol, wherein said recombinant microorganism comprises an isobutanol producing metabolic pathway, and wherein the activity of Grx4 or a homolog thereof is increased. In yet another embodiment, the present invention provides a recombinant microorganism for producing isobutanol, wherein said recombinant microorganism comprises an isobutanol producing metabolic pathway, and wherein the activity of Grx3 and Grx4 or homologs thereof is increased.

In alternative embodiments, proteins having a homology to Grx3 and/or Grx4 of at least about 50%, of at least about 60%, of at least about 70%, at least about 80%, or at least about 90% similarity can be used for a similar purpose.

Altering the Iron-Sulfur Cluster Domain and/or Redox Active Domain

In general, the yeast cytosol demonstrates a different redox potential than a bacterial cell, as well as the yeast mitochondria. As a result, isobutanol pathway enzymes such as DHAD which exhibit an iron sulfur (FeS) domain and/or redox active domain, may require the redox potential of the native environments to be folded or expressed in a functional form. Expressing the protein in the yeast cytosol, which can harbor unfavorable redox potential, has the propensity to result in an inactive protein, even if the protein is expressed. The present inventors have identified a number of different strategies to overcome this problem, which can arise when an isobutanol pathway enzyme such as DHAD which is suited to a particular environment with a specific redox potential is expressed in the yeast cytosol.

In one embodiment, the present invention provides DHAD enzymes that exhibit a properly folded iron-sulfur cluster domain and/or redox active domain in the cytosol. Such DHAD enzymes may either be native or heterologous DHAD homologs or functional analogs or comprise a mutated or modified iron-sulfur cluster domain and/or redox active domain, allowing for a DHAD enzyme to be expressed in the yeast cytosol in a functional form. Thus, if an enzyme in the isobutanol production pathway was identified that was fully soluble and active in the cytosol of said recombinant microorganism, such enzyme can be used without addition of chaperone proteins not already present in the cytosol or without increased expression of chaperone proteins already present in the cytosol. However, some DHAD proteins may need the assistance of additional chaperones or increased chaperone levels to exhibit optimal cytosolic activity.

Therefore, in various embodiments described herein, the recombinant microorganisms may further comprise a nucleic acid encoding a chaperone protein, wherein said chaperone protein assists the folding of a protein exhibiting cytosolic activity. Addition of the chaperone protein can lead to improved activity, solubility, and/or correct folding of the DHAD enzyme. In one embodiment, the chaperone may be a native protein. In another embodiment, the chaperone protein may be an exogenous protein. In some embodiments, the chaperone protein may be selected from the group consisting of: endoplasmic reticulum oxidoreductin 1 (Ero1, accession no. NP_013576.1), including variants of Ero1 that have been suitably altered to reduce or prevent its normal localization to the endoplasmic reticulum; thioredoxins (which includes Trx1, accession no. NP_013144.1; and Trx2, accession no. NP_011725.1), thioredoxin reductase (Trr1, accession no. NP_010640.1); glutaredoxins (which includes Grx1, accession no. NP 009895.1; Grx2, accession no. NP_010801.1; Grx3, accession no. NP_010383.1; Grx4, accession no. NP_01101.1; Grx5, accession no. NP_015266.1; Grx6, accession no. NP_010274.1; Grx7, accession no. NP_009570.1; Grx8, accession no. NP_013468.1); glutathione reductase Girl (accession no. NP_015234.1); Jac1 (accession no. NP_011497.1), including variants of Jac1 that have been suitably altered to reduce or prevent its normal mitochondrial localization; Hsp60 and Hsp10 proteins (e.g., yeast Hsp 60 and Hsp10 proteins, or other eukaryotic Hsp60 and Hsp10 homologs), bacterial chaperonin homologs (e.g., GroEL and GroES proteins from *Lactococcus lactis*); homologs or active variants thereof, and combinations thereof.

As described herein, it is preferred that the DHAD enzymes are properly assembled and folded, thus allowing for said DHADs to exhibit maximal activity in the cytosol. In yeast, the DHAD Ilv3 is involved in biosynthesis of the amino acids leucine, isoleucine and valine. Ilv3 is typically localized to the mitochondria, where the chaperonin proteins Hsp60 and Hsp10 aid in the proper folding of the protein (Dubaquie et. al. The EMBO Journal 1998 17: 5868-5876). In wild-type yeast cells, Ilv3 is found in the soluble fraction of cell lysates. In extracts from an hsp60 temperature-sensitive mutant, at the non-permissive temperature, there is no detectable soluble Ilv3. All of the protein is found in the insoluble fraction, in a presumably inactivated state. In an hsp10 temperature-sensitive mutant, at the non-permissive temperature, about half of the Ilv3 is found in the insoluble portion, indicating that Hsp10 is also important for proper folding of Ilv3, but that Hsp60 is required. (Dubaquie et. al. The EMBO Journal 1998 17: 5868-5876).

Thus, in one embodiment of the present invention, wherein the yeast DHAD encoded by ILV3 gene is used in the cytosol of a isobutanol-producing recombinant microorganism (e.g., a yeast microorganism), Hsp60 and/or Hsp10 from the same yeast, homologs thereof from other microorganisms, or active variants thereof can be overexpressed in said microorganism to increase the activity, solubility, and/or correct folding of DHAD encoded by ILV3 gene to increase the productivity, titer, and/or yield of isobutanol produced. Alternatively, if said microorganism is a yeast and it naturally expresses chaperonin proteins homologous to Hsp60 and/or Hsp10 in its cytosol, DHAD encoded by ILV3 can be expressed in said yeast without the overexpression of the Hsp60 and/or the Hsp10 proteins. In another embodiment, wherein the DHAD derived from an organism other than yeast is used for isobutanol production, chaperonin homologs, or active variants thereof derived from said non-yeast organism or related non-yeast organism can be overexpressed together with the DHAD derived from said non-yeast organism. In one embodiment, said non-yeast organism is an eukaryotic organism. In another embodiment, said non-yeast organism is a prokaryotic organism. In a further embodiment, said non-yeast organism is a bacterium (e.g., *E. coli.*, or *Lactococcus lactis*). For example, the *Lactococcus lactis* GroEL and GroES chaperonin proteins are expressed in the yeast cytosol in conjunction with the IlvD from *Lactococcus lactis*. Overexpression of these genes may be accomplished by methods as described herein.

Also disclosed herein are recombinant microorganisms comprising one or more genes encoding an iron-sulfur cluster assembly protein. Iron-sulfur cluster assembly for insertion into yeast apo-iron-sulfur proteins begins in yeast mitochondria. To assemble in yeast the active iron-sulfur proteins containing the cluster, either the apo-iron-sulfur protein is imported into the mitochondria from the cytosol and the iron-sulfur cluster is inserted into the protein and the active protein remains localized in the mitochondria; or the iron-sulfur clusters or precursors thereof are exported from the mitochondria to the cytosol and the active protein is assembled in the cytosol or other cellular compartments.

Targeting of yeast mitochondrial iron-sulfur proteins or non-yeast iron-sulfur proteins to the yeast cytosol can result in such proteins not being properly assembled with their iron-sulfur clusters. This present invention overcomes this problem by co-expression and cytosolic targeting in yeast of proteins for iron-sulfur cluster assembly and cluster insertion into apo-iron-sulfur proteins, including iron-sulfur cluster assembly and insertion proteins from organisms other than yeast, together with the apo-iron-sulfur protein to provide assembly of active iron-sulfur proteins in the yeast cytosol.

In some embodiments, the present invention provides methods of using Fe—S cluster containing protein in the eukaryotic cytosol for improved isobutanol production in a microorganism, comprising overexpression of a Fe—S cluster-containing protein in the isobutanol production pathway in an microorganism. In a preferred embodiment, said microorganism is a yeast microorganism. In one embodiment, said Fe—S cluster-containing protein is a endogenous protein. In another embodiment, said Fe—S cluster-containing protein is an exogenous protein.

In one embodiment, said Fe—S cluster-containing protein is derived from a eukaryotic organism. In another embodiment, said Fe—S cluster-containing protein is derived from a prokaryotic organism. In one embodiment, said Fe—S cluster-containing protein is DHAD. In one embodiment, said Fe—S cluster is a 2Fe-2S cluster. In another embodiment, said Fe—S cluster is a 4Fe-4S cluster.

All known DHAD enzymes contain an iron sulfur cluster, which is assembled in vivo by a multi-component pathway. DHADs contain one of at least two types of iron sulfur clusters, a 2Fe-2S cluster as typified by the spinach enzyme (Flint and Emptage, *JBC* 1988 263(8): 3558) or a 4Fe-4S cluster as typified by the *E. coli* enzyme (Flint et. al., *JBC* 1993 268(20): 14732). In eukaryotic cells, iron-sulfur cluster proteins can be found in either the cytosol or, more commonly, in the mitochondria. Within the mitochondria, a set of proteins, collectively similar to the ISC and/or SUF systems of *E. coli*, are present and participate in the assembly, maturation, and proper insertion of Fe—S clusters into mitochondrial target proteins. (Lill and Mühlenhoff, 2008, *Annu. Rev. Biochem.*, 77:669-700). In addition, a cytosolic iron sulfur assembly system is present and is collectively termed the CIA machinery. The CIA system promotes proper Fe—S cluster maturation and loading into cytosolically-localized iron sulfur proteins such as Leu1. Importantly, function of the CIA system is dependent on a critical (but still uncharacterized) factor exported from the mitochondria. In the yeast *S. cerevisiae*, the native DHAD, encoded by ILV3, is a mitochondrially-localized protein, where it is presumably properly recognized and activated by Fe—S cluster insertion by the endogenous machinery. Accordingly, ectopic expression of a DHAD in the yeast cytosol might be not expected to be functional due to its presence in a non-native compartment and the concomitant lack of appropriate Fe—S cluster assembly machinery.

The *E. coli* DHAD (encoded by ilvD) is sensitive to oxygen, becoming quickly inactivated when isolated under aerobic conditions (Flint et. al., *JBC* 1993 268(20): 14732; Brown et. al. *Archives Biochem. Biophysics* 1995 319(1): 10). It is thought that this oxygen sensitivity is due to the presence of a labile 4Fe-4S cluster, which is unstable in the presence of oxygen and reactive oxygen species, such as oxygen radicals and hydrogen peroxide. In yeast and other eukaryotes, the mitochondrial environment is reducing, i.e. it is a low oxygen environment, in contrast to the more oxygen-rich environment of the cytosol. The redox state of the cytosol is thus expected to be a problem for expressing mitochondrially localized DHADs, which are natively located in the mitochondria, or in expressing DHADs from many bacterial species which typically have an intracellular reducing environment. The spinach DHAD has been shown to be more oxygen resistant than the *E. coli* enzyme in in vitro assays (Flint and Emptage, *JBC* 1988 263(8):3558), which may be due to its endogenous localization to the plastid, where it would normally encounter a relatively high-oxygen environment. It has been suggested that DHADs with 2Fe-2S clusters are inherently more resistant to oxidative damage and they are therefore an attractive possibility for inclusion in the cytosolically localized isobutanol pathway.

An additional complication to the oxygen sensitivity of DHADs is that the iron sulfur clusters must be properly assembled and inserted into the enzyme such that an active enzyme results. There are several types of machinery that produce iron sulfur clusters and properly assemble them into proteins, including the NIF system found in bacteria and in some eukaryotes, the ISC system found in bacteria and mitochondria, the SUF system found in bacteria and plastids, and the CIA system found in the cytosol of eukaryotes.

Thus, the methods of using Fe—S cluster in the eukaryotic cytosol for improved enzymatic activity in isobutanol production pathway as described above may further comprise the co-expression a heterologous Fe—S cluster-containing DHAD with the NIF assembly system in the yeast cytosol to aid in assembling said heterologous DHADs. The NIF system found in the parasite *Entamoeba histolytica* has been shown to complement the double deletion of the *E. coli* ISC and SUF assembly systems (Ali et. al. JBC 2004 279(16): 16863). The critical components of the *Entamoeba* assembly system comprise only two genes, NifS and NifU. In one embodiment, these two components are overexpressed in the yeast cytosol to increase activity and/or stability of cytosolic DHADs. In one embodiment, the NIF system is the *E. hisotlytica* NIF system; in another embodiment, the NIF system is from other organisms (e.g. *Lactococcus lactis*). An advantage of using the *E. hisotlytica* assembly system is that it has already been demonstrated to work in a heterologous organism, *E. coli*.

A 2Fe-2S cluster-containing DHAD can be used in the present invention. In one embodiment, the 2Fe-2S cluster DHADs includes all known 2Fe-2S cluster dehydratase enzymes identified biochemically. In another embodiment, the 2Fe-2S cluster DHADs include those predicted to be 2Fe-2S cluster dehydratases containing some version of the consensus motif for 2Fe-2S cluster proteins, e.g., the motif $CX_4CX_2CX_{\sim30}C$ (SEQ ID NO: 39, Lill and Mühlenhoff, 2008, *Annu. Rev. Biochem.*, 77:669-700). For example, based on the extremely highly conserved DHAD gene sequences shared amongst plant species, the inventors have synthesized a likely 2Fe-2S DHAD from *Arabidopsis* (and rice, *Oryza sativa* japonica) which can be used to improve isobutanol production in vivo in the cytosolic isobutanol pathway.

Figure 2:
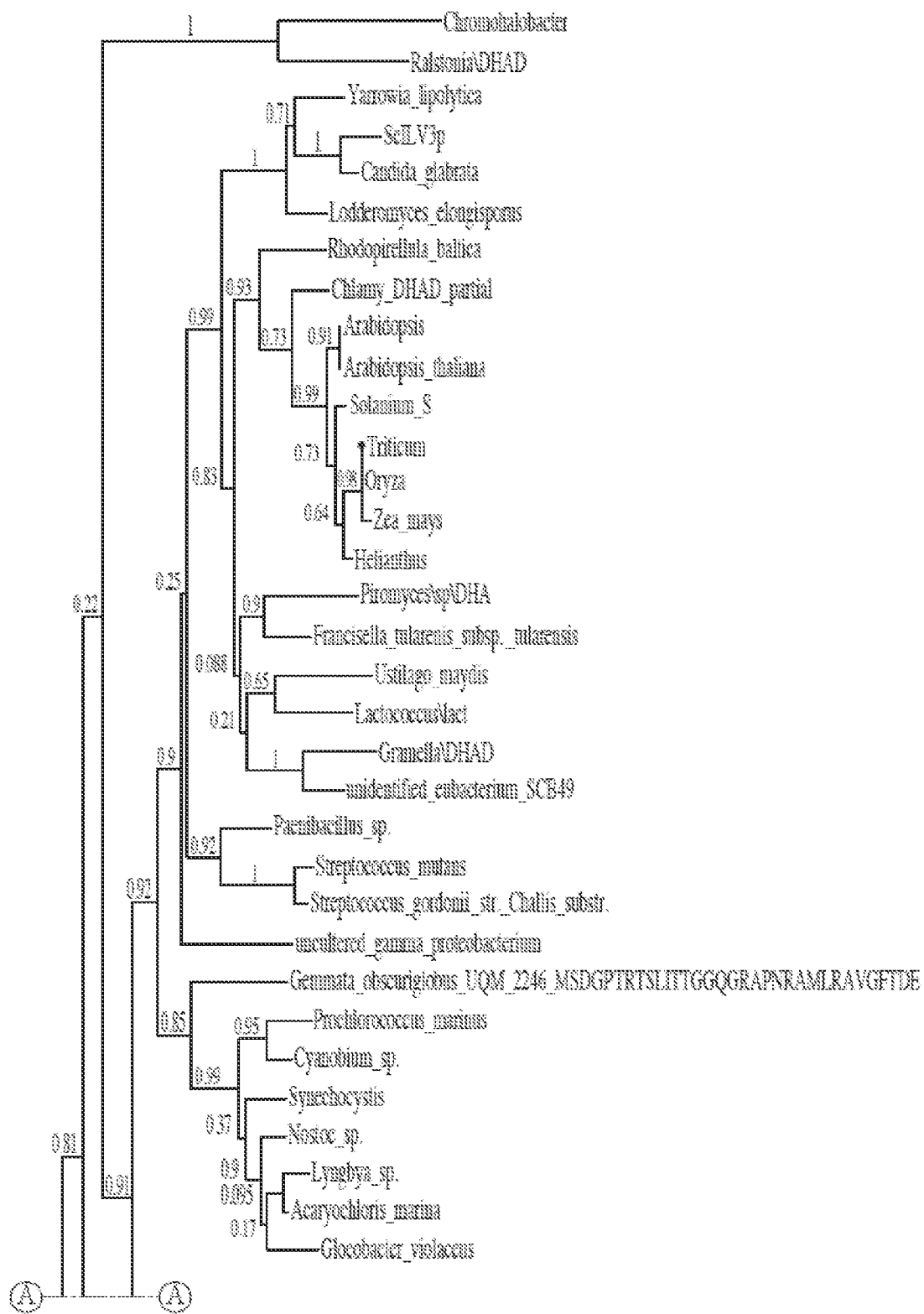
FIG. 2 illustrates a phylogenetic tree of DHAD proteins. Numbers at nodes indicate bootstrap values. Ec_ilvD is a known 4Fe-4S DHAD enzyme from *Escherichia coli*.
Figure 2:
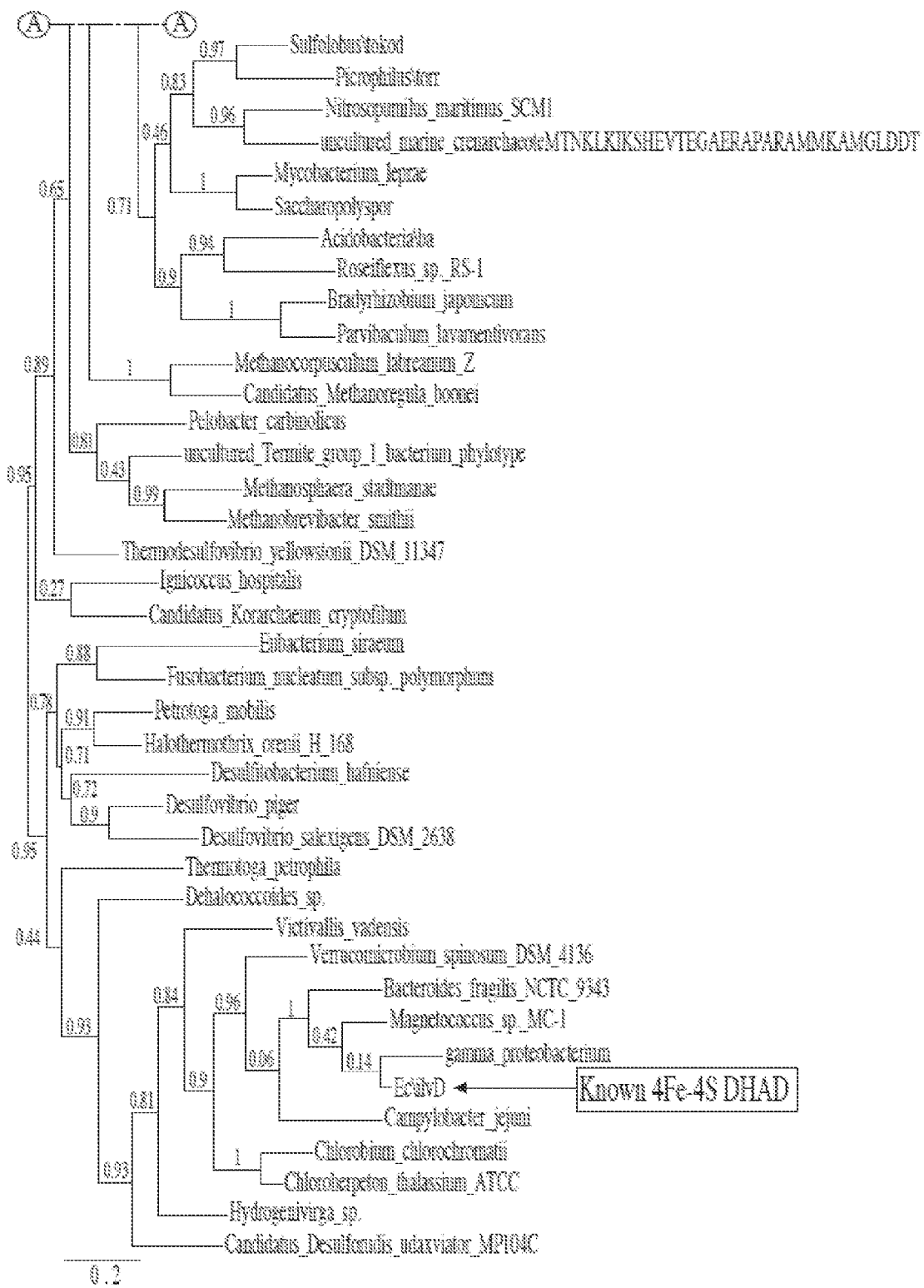

Alternatively, a DHAD may be determined to be a 2Fe-2S protein or a 4Fe-4S protein based on a phylogenetic tree, such as FIG. 2. Sequences not present on the example phylogenetic tree disclosed here could be added to the tree by one skilled in the art. Furthermore, once a new sequence was added to the DHAD phylogenetic tree, one skilled in the art may be able to determine if it is a 2Fe-2S or a 4Fe-4S cluster containing protein based on the phylogenetic relationship to known 2Fe-2S or a 4Fe-4S cluster containing DHADs.

In another embodiment, a 4Fe-4S cluster-containing DHAD could substitute for the 2Fe-2S cluster-containing DHAD in the cytosol. In one embodiment, said 4Fe-4S cluster DHAD is engineered to be oxygen resistant, and therefore more active in the cytosol of cells grown under aerobic conditions.

In one embodiment of this invention, the apo-iron-sulfur protein DHAD enzyme encoded by the *E. coli* ilvD gene is expressed in yeast together with *E. coli* iron-sulfur cluster assembly and insertion genes comprising either the cyaY, iscS, iscU, iscA, hscB, hscA, fdx and isuX genes or the sufA, sufB, sufC, sufD, sufS and sufE genes. This strategy allows for both the apo-iron-sulfur protein (DHAD) and the iron-sulfur cluster assembly and insertion components (the products of the isc or suf genes) to come from the same organism, causing assembly of the active DHAD iron-sulfur protein in the yeast cytosol. As a modification of this embodiment, for those *E. coli* iron-sulfur cluster assembly and insertion components that localize to or are predicted to localize to the yeast mitochondria upon expression in yeast, the genes for these components are engineered to eliminate such targeting signals to ensure localization of the components in the yeast cytoplasm. Thus, in some embodiments, one or more genes encoding an iron-sulfur cluster assembly protein may be mutated or modified to remove a signal peptide, whereby localization of the product of said one or more genes to the mitochondria is prevented. In certain embodiments, it may be preferable to overexpress one or more genes encoding an iron-sulfur cluster assembly protein.

In additional embodiments, iron-sulfur cluster assembly and insertion components from other than *E. coli* can be co-expressed with the *E. coli* DHAD protein to provide assembly of the active DHAD iron-sulfur cluster protein. Such iron-sulfur cluster assembly and insertion components from other organisms can consist of the products of the *Helicobacter pylori* nifS and nifU genes or the *Entamoeba histolytica* nifS and nifU genes. As a modification of this embodiment, for those non-*E. coli* iron-sulfur cluster assembly and insertion components that localize to or are predicted to localize to the yeast mitochondria upon expression in yeast, the genes for these components can be engineered to eliminate such targeting signals to ensure localization of the components in the yeast cytoplasm.

As a further modification of this embodiment, in addition to co-expression of these proteins in aerobically-grown yeast, these proteins may be co-expressed in anaerobically-grown yeast to lower the redox state of the yeast cytoplasm to improve assembly of the active iron-sulfur protein.

In another embodiment, the above iron-sulfur cluster assembly and insertion components can be co-expressed with DHAD apo-iron-sulfur enzymes other than the *E. coli* IlvD gene product to generate active DHAD enzymes in the yeast cytoplasm. As a modification of this embodiment, for those DHAD enzymes that localize to or are predicted to localize to the yeast mitochondria upon expression in yeast, then the genes for these enzymes can be engineered to eliminate such targeting signals to ensure localization of the enzymes in the yeast cytoplasm.

In additional embodiments, the above methods used to generate active DHAD enzymes localized to yeast cytoplasm may be combined with methods to generate active acetolactate synthase, KAR1, KIVD and ADH enzymes in the same yeast for the production of isobutanol by yeast.

In another embodiment, production of active iron-sulfur proteins other than DHAD enzymes in yeast cytoplasm can be accomplished by co-expression with iron-sulfur cluster assembly and insertion proteins from organisms other than yeast, with proper targeting of the proteins to the yeast cytoplasm if necessary and expression in anaerobically growing yeast if needed to improve assembly of the active proteins.

In another embodiment, the iron-sulfur cluster assembly protein encoding genes may be derived from eukaryotic organisms, including, but not limited to yeasts and plants. In one embodiment, the iron-sulfur cluster protein encoding genes are derived from a yeast organism, including, but not limited to *S. cerevisiae*. In specific embodiments, the yeast-derived genes encoding iron-sulfur cluster assembly proteins are selected from the group consisting of Cfd1 (accession no. NP_012263.1), Nbp35 (accession no. NP_011424.1), Nar1 (accession no. NP_014159.1), Cia1 (accession no. NP_010553.1), and homologs or variants thereof. In a further embodiment, the iron-sulfur cluster assembly protein encoding genes may be derived from plant nuclear genes which encode proteins translocated to chloroplasts or plant genes found in the chloroplast genome itself.

In certain embodiments described herein, it may be desirable to reduce or eliminate the activity and/or proteins levels of one or more iron-sulfur cluster containing cytosolic proteins. This modification increases the capacity of a yeast to incorporate [Fe—S] clusters into cytosolically expressed proteins wherein said proteins can be native proteins that are expressed in a non-native compartment or heterologous proteins. This is achieved by deletion of a highly expressed native cytoplasmic [Fe—S]-dependent protein. More specifically, the gene LEU1 is deleted coding for the 3-isopropylmalate dehydratase which catalyses the conversion of 3-isopropyl-malate into 2-isopropylmaleate as part of the leucine biosynthetic pathway in yeast. Leu1p contains an 4Fe-4S cluster which takes part in the catalysis of the dehydratase. Some DHAD enzymes also contain a 4Fe-4S cluster involved in its dehydratase activity. Therefore, although the two enzymes have different substrate preferences the process of incorporation of the Fe—S cluster is generally similar for the two proteins. Given that Leu1p is present in yeast at 10000 molecules per cell (Ghaemmaghami S. et al. *Nature* 2003 425: 737), deletion of LEU1 therefore ensures that the cell has enough spare capacity to incorporate [Fe—S] clusters into at least 10000 molecules of cytosolically expressed DHAD. Taking into account the specific activity of DHAD (*E. coli* DHAD is reported to have a specific activity of 63 U/mg (Flint, D. H. of al., *JBC* 1993 268: 14732), the LEU1 deletion yeast strain would generally exhibit an increased capacity for DHAD activity in the cytosol as measured in cell lysate.

In alternative embodiments, it may be desirable to further overexpress an additional enzyme that converts 2,3-dihydroxyisovalerate to ketoisovalerate in the cytosol. In a specific embodiment, the enzyme may be selected from the group consisting of 3-isopropylmalate dehydratase (Leu1p) and imidazoleglycerol-phosphate dehydrogenase (His3p) or other dehydratases listed in Table 3.

TABLE 3

Dehydratases with putative activity towards 2,3-dihydroxyisovalerate.

| Gene | Species | Native Substrate | Comments |
|------|---------|------------------|----------|
| dgoD | E. coli | D-galactonate | Acid-sugar dehydratases |
| rspA | E. coli | D-mannonate, D-altronate | |

TABLE 3-continued

Dehydratases with putative activity towards 2,3-dihydroxyisovalerate.

| Gene | Species | Native Substrate | Comments |
|---|---|---|---|
| yfaW | E. coli | L-rhamnonate | |
| fucD | X. campestris | L-fuconate | |
| LGD1 | H. jecorina | L-galactonate | |
| pdd | K. oxytoca | diols | Other non-Fe—S dehydratases |
| ENO1/2, ERR1/2/3 | S. cerevisiae | 2-phosphoglycerate | |
| HIS3 | S. cerevisiae | Imidazoleglycerol-phosphate | |

Because in some embodiments, DHAD activity may be limited in the cytosol, alternative dehydratases that convert dihydroxyisovalerate (DHIV) to 2-ketoisovalerate (KIV) and are physiologically localized to the yeast cytosol may be utilized. Leu1p and His3p and other enzymes encoded by genes listed in Table 3 are dehydratases that potentially may exhibit affinity for DHIV. Leu1p is an Fe—S binding protein that is involved in leucine biosynthesis and is also normally localized to the cytosol. His3p is involved in histidine biosynthesis and is similar to Leu1p, it is generally localized to the cytosol or predicted to be localized to the cytosol. This modification overcomes the problem of a DHAD that is limiting isobutanol production in the cytosol of yeast. The use of an alternative dehydratase that has activity in the cytosol with a low activity towards DHIV may thus be used in place of the DHAD in the isobutanol pathway. As described herein, such enzyme may be further engineered to increase activity with DHIV.

Increased Mitochondrial Export of Essential Components for Iron Sulfur Protein Assembly in the Cytosol As noted herein, the third step in an exemplary isobutanol biosynthetic pathway is the conversion of dihydroxyisovalerate (DHIV) to ketoisovalerate (KIV) by a dihydroxyacid dehydratase (DHAD). DHADs often require iron sulfur clusters for activity, and the native yeast DHAD acquires its iron sulfur cluster via the mitochondrial ISC machinery, remaining within the mitochondria as an active enzyme. However, isobutanol production by the engineered pathway requires DHAD to be functionally expressed within the cytosol, and such a DHAD presumably requires iron sulfur clusters to be added in the cytosol. One of the inventions disclosed herein addresses possible genetic or chemical approaches to increase the functional activity of cytosol DHADs. The present invention provides ways to increase the export of an essential compound that is generated in mitochondria, thereby increasing the amount of the compound available for use by the cytosolic iron sulfur assembly machinery (e.g. CIA) to effectively increase the functional expression of cytosolic DHADs.

Overexpressinq Mitochondrial Iron Sulfur Cluster (ISC) Machinery

The compound generated within the mitochondrial matrix that is essential for iron sulfur protein assembly in the cytosol is subsequently exported through the ABC transporter, Atm1, and is chaperoned across the intermembrane space of the mitochondria to the cytosol by Erv1 (reviewed in Lill and Mühlenhoff, 2008, *Annu. Rev. Biochem.*, 77:669-700). Sc_BAT1 was identified as a third putative component of the mitochondrial export machinery required for the export of an unknown compound essential for cytosolic iron-sulfur cluster biosynthesis from the mitochondrial matrix to the cytosol by a genetic selection of suppressors of a Sc_atm1 temperature sensitive allele (Kispal et al, 1996, *JBC*, 271:24458-24464). It is also suggested that a further strong indication for a direct functional relationship between Atm1p and Bat1p is the leucine auxotrophy associated with the deletion of the ATM1 gene.

To facilitate export of the essential compound, the present invention provides in an embodiment recombinant microorganisms that have been engineered to overexpress one or more mitochondrial export proteins. In various embodiments described herein, the mitochondrial export protein may be selected from the group consisting of the S. cerevisiae ATM1, the S. cerevisiae ERV1, and the S. cerevisiae BAT1, or homologs thereof. Such manipulations can increase the export of the essential compound out of the mitochondria to increase the amount available for use by the cytosolic iron sulfur assembly machinery (e.g. CIA) to effectively increase the functional expression of cytosolic DHADs.

Increasing Inner Mitochondrial Membrane Electrical Potential

In one embodiment, the present invention provides recombinant microorganisms that have further been engineered to increase inner mitochondrial membrane potential, $\Delta\psi_M$. As described herein, although yeast cells require a function mitochondrial compartment, they are viable without the mitochondrial genome (mtDNA). However, loss of mtDNA has been linked to destabilization of the nuclear genome (Veatch et al., 2009, *Cell*, 137(7):1179-1181). Nuclear genome stability was restored in yeast lacking mtDNA when a suppressor mutation (ATP1-111) was introduced (Veatch et al., 2009, *Cell*, 137(7):1179-1181, Francis et al. 2007, *J. Bioenerg. Biomembr.* 39(2):149-157). The mutation has been shown to increase ATP hydrolysis activity of the mitochondrial ATP synthase, and similar mutations in the ATP synthase complex have also been shown to increase the electrical potential across the inner membrane of mitochondria, $\Delta\psi_M$, in cells lacking mtDNA (Smith et al., 2005, *Euk Cell*, 4(12):2057-2065; Kominsky et al., 2002, *Genetics*, 162:1595-1604). Generation of $\Delta\psi_M$ is required for efficient import of proteins into the mitochondrial matrix, including those involved in assembly and export of a complex required for the assembly of iron sulfur clusters into proteins in the cytosol. The link between $\Delta\psi_M$ and iron sulfur cluster assembly in the cytosol is supported by microarray data that indicate that the transcriptional profile of cells lacking mtDNA (decreased $\Delta\psi_M$) is similar to yeast grown under iron depletion conditions (Veatch et al., 2009, *Cell*, 137(7):1179-1181). Introduction of the ATP1-111 suppressor mutation restores the transcriptional profile to one resembling a wild-type cell's transcriptional profile (Veatch et al., 2009, *Cell*, 137(7):1179-1181). Taken together, these data indicate that $\Delta\psi_M$ must be sufficient to support assembly of cytosolic iron sulfur proteins, particularly those involved in nuclear genome stability (Veatch et al., *Cell* 2009, 137(7):1247-1258).

Thus, the present invention aims to generate the highest possible $\Delta\psi_M$ in a yeast with an intact mitochondrial genome, allowing for the maximization the export of the complex required for assembly of cytosolic iron sulfur proteins, which can in turn increase the amount available for use by the cytosolic iron sulfur assembly machinery (e.g. CIA) to effectively increase the functional expression of cytosolic DHADs. $\Delta\psi_M$ can be maximized several different ways, including, but not limited to: (1) Introducing mutations in the mitochondrial ATP synthase complex that increase ATP hydrolysis activity, or active variants thereof; (2) Overexpressing an ATP/ADP carrier protein that leads to an increase $ATP^{4-}$ import into the mitochondrial matrix in exchange for $ADP^{3-}$, contributing to generation of $\Delta\psi_M$; (3) Removal and/ or overexpression of additional gene(s) involved in generation of $\Delta\psi_M$; and (4) Addition of chemical reagents that lead to an increase in $\Delta\psi_M$.

In various embodiments described herein, the recombinant microorganism may comprise a mutation in the mitochondrial ATP synthase complex that increases ATP hydrolysis activity. In one embodiment, said mutant mitochondrial is an ATP synthase which can increase ATP hydrolysis activity is from a eukaryotic organism (e.g., a yeast ATP1, ATP2, ATP3). In another embodiment, said mutant mitochondrial ATP synthase is from a prokaryotic organism (e.g., bacteria). Non-limiting examples of said mutant mitochondrial ATP synthase include, mutant ATPase from the ATP1-111 strain in Francis et al., *J Bioenerg Biomembr*, 2007, 39(2):127-144), a mutant ATPase from the atp2-227 strain in Smith et al., 2005, *Euk Cell*, 4(12):2057-2065, or a mutant ATPase from the yme1 strain in Kominsky et al., 2002, *Genetics*, 162:1595-1604). In another embodiment, active variants, or homologs of the mutant mitochondrial ATP synthases described above can be applied. In one embodiment, an ATP synthase having a homology to any of ATP1, ATP2, and ATP3 of at least about 70%, at least about 80%, or at least about 90% similarity can be used for a similar purpose.

In one embodiment, the inner mitochondrial membrane electrical potential can be increased by overexpressing an ATP/ADP carrier protein. Overexpression of the ATP/ADP carrier protein increases $ATP^{4-}$ import into the mitochondrial matrix in exchange for $ADP^{3-}$. Non-limiting examples of ATP/ADP carrier proteins include the *S. cerevisiae*_AAC1 or the *S. cerevisiae*_AAC3, and active variants or homologs thereof. In one embodiment, an ATP/ADP carrier protein having a homology to either the *S. cerevisiae*_AAC1 or *S. cerevisiae*_AAC3 of at least about 70%, at least about 80%, or at least about 90% similarity can be used for a similar purpose.

In another embodiment, the inner mitochondrial membrane electrical potential can be increased by removal and/or overexpression of additional gene(s) involved in the generation of $\Delta\psi_M$. A person skilled in the art will be familiar with proteins encoded by such genes. Non-limiting examples include the protein complexes in the mitochondrial electron transport chain which are responsible for establishing $H^+$ ions gradient. For examples, complexes on the inner membrane of mitochondria that are involved in conversion of NADH to $NAD^+$ (Complex I, NADH dehydrogenase), succinate to fumarate (Complex II, cytochrome $bc_1$ complex), and oxygen to water (Complex IV, cytochrome c oxidase), which are responsible for the transfer of $H^+$ ions. In another embodiment, enzymes in the citric acid cycle in the matrix of mitochondria can be overexpressed to increase NADH and succinate production, such that more $H^+$ ions are available. These enzymes include, citrate synthase, aconitase, isocitrate dehydrogenase, α-Ketoglutarate dehydrogenase, succinyl-CoA synthetase, succinate dehydrogenase, fumarase, and malate dehydrogenase.

In yet another embodiment, the inner mitochondrial membrane electrical potential can be increased by the addition of chemical reagents that lead to an increase in $\Delta\psi_M$. In one embodiment, said chemical reagents are substrates in the citric acid cycle in the matrix of mitochondria, wherein when added into the culture, more NADH and succinate can be produced which in turn increase $\Delta\psi_M$ in the mitochondria. Non-limiting examples of said substrates include, oxaloacetate, acetyl CoA, citrate, cis-Aconitate, isocitrate, oxalosuccinate, α-Ketoglutarate, succinyl-CoA, succinate, fumarate and L-Malate.

Enhancing Cytosolic DHADs Activity by Increasing Cytosol Sulfur Levels

Also provided herein are methods of increasing the levels of sulfur-containing compounds within yeast cells, including the amino acid cysteine, such that this sulfur is more available for the production of iron-sulfur cluster-containing proteins in the yeast cytosol or mitochondria. Specifically, by increasing the concentration of sulfur-containing compounds in the cell such, the activity of a functional DHAD is enhanced in the yeast cytosol or mitochondria.

Accordingly, the present invention provides in an embodiment recombinant microorganisms that have been engineered to overexpress one or more genes to increase biosynthesis of cysteine or uptake of exogenous cysteine by the cell in order to increase the amount and availability of sulfur-containing compounds for the production of active iron-sulfur cluster-containing proteins in the yeast cytosol or mitochondria. In one embodiment, the recombinant microorganisms have been engineered to increase the expression of one or more proteins to increase cysteine biosynthesis by the cell, including, but not limited to MET3, MET14, MET16, MET10, MET5, MET1, MET8, MET2, MET17, HOM3, HOM2, HOM6, CYS3, CYS4, SUL1, SUL2, active variants thereof, homologs thereof, and combination thereof, to increase cysteine biosynthesis by the cell. In another embodiment, the recombinant microorganisms have been engineered to increase the expression of one or more transport proteins, including, but not limited to YCT1, MUP1, GAP1, AGP1, GNP1, BAP1, BAP2, TAT1, active variants thereof, homologs thereof, and combination thereof.

As noted above, increasing uptake of exogenous cysteine by the cell will increase the amount and availability of sulfur-containing compounds for the production of active iron-sulfur cluster containing proteins in the cytosol or mitochondria of the cell. Addition of increased exogenous cysteine to yeast cells, separately from or in addition to increased expression of the transport protein-encoding genes as described above, can also increase the level and availability of sulfur-containing compounds within the cell such that the sulfur is more available for the production of iron-sulfur cluster-containing proteins in the cell cytosol or mitochondria.

Sulfur is a necessary element for the biogenesis of iron-sulfur cluster (FeS cluster)-containing protein in vivo. Sulfur is a component of the FeS clusters that are incorporated into such proteins and is also a component of compounds such as glutathiones, which are essential for FeS cluster biogenesis in many organisms as well as being involved in cellular redox homeostasis. The direct source of the sulfur for these processes in many organisms is the amino acid cysteine. The sulfur from cysteine is mobilized into FeS clusters during FeS cluster biogenesis using cysteine desulfurase proteins identified in many organisms such as IscS, SufS (together with SufE), NifS and Nfs1 (together with Isd11). Additionally, glutathione biosynthesis requires cysteine.

Increased expression of Fe—S cluster-containing proteins in organisms such as the budding yeast *S. cerevisiae* results in an increased demand for sulfur, in the form of cysteine, in the cell. Such an increased demand for cysteine may possibly be met by natural induction of the endogenous cysteine biosynthetic pathway but maximal natural induction of this pathway may be insufficient to provide enough cysteine for the proper assemble and maintenance of increased levels of FeS cluster-containing proteins in the cell. Such cells with an increased demand for cysteine may also induce cysteine and/or sulfate transport pathways to bring in exogenous cysteine for or sulfate, which is the sulfur donor for cysteine biosynthesis.

However, maximal natural induction of these transport systems may also be insufficient to meet the sulfur requirement of such cells.

Assembly of active FeS cluster-containing proteins in the native yeast cytosol requires the production and export to the cytosol by the mitochondria of an unidentified sulfur-containing compound derived from the mitochondrial FeS cluster biogenesis pathway and the amino acid cysteine and requiring glutathione for export. Overexpression of an FeS cluster-containing protein in the yeast cytosol or the localization of a previously non-cytosolic FeS cluster-containing protein to the yeast cytosol may result in the decreased availability of this unidentified sulfur-containing compound in the yeast cytosol and low activity of the cytosolic FeS cluster-containing protein or proteins. Increased availability of cysteine to the cell may prevent this limitation by providing increased sulfur for the biosynthesis of this compound and sufficient glutathione for its export from the mitochondria.

Sulfur for the assembly of FeS cluster-containing proteins expressed in the yeast cytosol may also be provided by localization of cysteine desulfurase proteins to the yeast cytosol. Expression of such proteins in the yeast cytosol may result in an increased demand for cysteine by such cells, especially in the cytosol. Additionally, damage to the FeS cluster of FeS cluster-containing proteins expressed in the yeast cytosol, due to the oxic nature of the yeast cytosol or due to reactive oxygen or nitrogen species, may require additional sulfur derived from cysteine for repair or regeneration of the damaged clusters. As well, additional sulfur derived from cysteine may modulate the redox balance of the yeast cytosol through the production of increased levels of compounds such as glutathione which may positively affect the assembly or activity of FeS cluster-containing proteins in the yeast cytosol.

Increased cellular sulfur in the form of cysteine can be provided by increasing the biosynthesis of cysteine in the cell or by increasing cellular uptake of exogenous cysteine. Increasing the cellular level of cysteine in these ways is expected to increase the level of other sulfur-containing compounds in the cell that derive their sulfur from cysteine or the cysteine biosynthesis pathway. Cysteine biosynthesis in *S. cerevisiae* involves the uptake of exogenous sulfate by transport proteins encoded by the SUL1 and/or SUL2 genes and the action of the proteins encoded by the MET3, MET14, MET16, MET10, MET5, MET1, MET8, MET2, MET17, HOM3, HOM2, HOM6, CYS4 and CYS4 genes. Exogenous cysteine is taken up into *S. cerevisiae* by the high-affinity transport system encoded by the YCT1 gene but also by the broader-specificity transport proteins encoded by the MUP1, GAP1, AGP1, GNP1, BAP1, BAP2, TAT1 and TAT2 genes.

Thus, in an additional aspect, the invention is directed to methods of increasing the levels of sulfur-containing compounds within the yeast cytosol and/or mitochondria, such that sulfur is more available for the production of iron-sulfur cluster-containing proteins in the cytosol or mitochondria. In one embodiment, the levels of sulfur-containing compounds within the yeast cytosol and/or mitochondria are increased. In another embodiment, an increase in sulfur-containing compounds in the yeast cytosol or mitochondria leads to an increase in activity of a cytosolically expressed FeS cluster-containing protein DHAD, which catalyzes the reaction of 2,3-dihydroxyisovalerate to 2-ketoisovalerate. In another embodiment, an increase in sulfur-containing compounds in the yeast cytosol or mitochondria leads to an increase in activity of a cytosolically expressed DHAD. In another embodiment, an increase in sulfur-containing compounds in the yeast cytosol and/or mitochondria leads to an increase in activity of a cytosolically expressed DHAD and a subsequent increase in the productivity, titer, and/or yield of isobutanol produced by the DHAD-containing strain. In another embodiment, an increase in sulfur-containing compounds in the yeast cytosol or mitochondria leads to an increase in activity of a mitochondrially expressed FeS cluster-containing protein DHAD, which catalyzes the reaction of 2,3-dihydroxyisovalerate to 2-ketoisovalerate. In another embodiment, an increase in sulfur-containing compounds in the yeast cytosol or mitochondria leads to an increase in activity of a mitochondrially expressed DHAD. In another embodiment, an increase in sulfur-containing compounds in the yeast cytosol and/or mitochondria leads to an increase in activity of a mitochondrially expressed DHAD and a subsequent increase in the productivity, titer, and/or yield of isobutanol produced by the DHAD-containing strain.

In another embodiment, the genes YCT1, MUP1, GAP1, AGP1, GNP1, BAP1, BAP2, TAT1, and TAT2, active variants thereof, homologs thereof or combination thereof are overexpressed from a plasmid or by inserting multiple copies of the gene or genes into the chromosome under the control of a constitutive promoter. This embodiment can also be combined with providing increased extracellular cysteine to the yeast cells to provide increased sulfur-containing compounds in the cytosol and/or mitochondria of the cells. Overexpression of these genes may be accomplished by methods as described above.

In another embodiment, providing increased extracellular cysteine to the yeast cells in the absence of any additional engineered expression of transport proteins will provide increased sulfur containing compounds in the cytosol and/or mitochondria of the cells for the improved production of active FeS cluster-containing proteins in the yeast cytosol or mitochondria, which leads to increased isobutanol productivity, titer, and/or yield by the cell.

Enhancing Cytosolic DHAD Activity by Mitigating Oxidative Species or Oxidative Stress The present application also describes methods of protecting enzymes in a DHAD-requiring biosynthetic pathway (specifically DHAD) in a microorganism to increase the production of beneficial metabolites by mitigating oxidative species or oxidative stress induced damage in the cytosol of said microorganism. Non-limiting examples of oxidative species include, nitric oxide (NO), reactive nitrogen species (RNS), reactive oxygen species (ROS), hydroxyl radical species, organic hydroperoxide, hypochlorous acids, and combinations thereof. As used herein, the phrase "reactive oxygen species" or "ROS" refers to free radicals that contain the oxygen atom. ROS are very small molecules that include oxygen ions and peroxides and can be either inorganic or organic. They are highly reactive due to the presence of unpaired valence shell electrons. During times of environmental stress (e.g. UV or heat exposure) ROS levels can increase dramatically, which can result in significant damage to cell structures. This cumulates into a situation known as oxidative stress. ROS are also generated by exogenous sources such as ionizing radiation.

Oxidative stress is caused by an imbalance between the production of reactive oxygen and a biological system's ability to readily detoxify the reactive intermediates or easily repair the resulting damage. All forms of life maintain a reducing environment within their cells. This reducing environment is preserved by enzymes that maintain the reduced state through a constant input of metabolic energy. Disturbances in this normal redox state can cause toxic effects through the production of peroxides and free radicals that damage all components of the cell, including proteins, lipids, and DNA.

In chemical terms, oxidative stress is a large rise (becoming less negative) in the cellular reduction potential, or a large decrease in the reducing capacity of the cellular redox couples, such as glutathione. The effects of oxidative stress depend upon the size of these changes, with a cell being able to overcome small perturbations and regain its original state. However, more severe oxidative stress can cause cell death and even moderate oxidation can trigger apoptosis, while more intense stresses may cause necrosis.

A particularly destructive aspect of oxidative stress is the production of reactive oxygen species, which include free radicals and peroxides, and/or other reactive species. Some of the less reactive of these species (such as superoxide) can be converted by oxidoreduction reactions with transition metals or other redox cycling compounds (including quinones) into more aggressive radical species that can cause extensive cellular damage. The major portion of long term effects is inflicted by damage on DNA. Most of these oxygen-derived species are produced at a low level by normal aerobic metabolism and the damage they cause to cells is constantly repaired. However, under the severe levels of oxidative stress that cause necrosis, the damage causes ATP depletion, preventing controlled apoptotic death and causing the cell to simply fall apart. Non-limiting example of oxidants include, superoxide anion ($.O_2-$, formed in many autoxidation reactions and by the electron transport chain), hydrogen peroxide ($H_2O_2$, formed by disputation of $.O_2-$ or by direct reduction of $O_2$), organic hydroperoxide (ROOH, formed by radical reactions with cellular components such as lipids and/or nucleobases), oxygen centered organic radicals (e.g., RO. alkoxy and ROO., peroxy radicals, formed in the presence of oxygen by radical addition to double bonds or hydrogen abstraction), hypochlorous acid (HOCl, formed from $H_2O_2$ by myeloperoxidase, and peroxynitrite (ONOO—, formed in a rapid reaction between $.O_2-$ and NO.).

Biological defenses against oxidative damage include protective proteins that remove reactive oxygen species, molecules that sequester metal ions, and enzymes that repair damaged cellular components. Oxidative stress can be defined as a disturbance in the prooxidant-antioxidant balance in favor of prooxidants. One such class of prooxidants are reactive oxygen species, or ROS. ROS are highly reactive species of oxygen, such as superoxide ($O2.^-$, hydrogen peroxide ($H_2O_2$), and hydroxyl radicals (OH.), produced within the cell, usually as side products of aerobic respiration. By some reports, as much as 2% of the oxygen that enters the respiratory chain is converted to superoxide through a one-electron reduction of oxygen. A small amount of superoxide radical is always released from the enzyme when oxygen is reduced by electron carriers such as flavoproteins or cytochromes. This is because the electrons are transferred to oxygen one at a time. The hydroxyl radical and hydrogen peroxide are derived from the superoxide radical.

Many microbes possess native enzymes to detoxify these ROS. One example of such a system is superoxide dismutase (SOD) plus catalase. SOD catalyzes a reaction where one superoxide radical transfers its extra electron to the second radical, which is then reduced to hydrogen peroxide. Catalase catalyzes the transfer of two electrons from one hydrogen peroxide molecule to the second, oxidizing the first to oxygen and reducing the second to two molecules of water. If the hydrogen peroxide is not disposed of, then it can oxidize transition metals, such as free iron(II) in the Fenton reaction, and form the free hydroxyl radical, OH. No known mechanisms exists to detoxify hydroxyl radicals, and thus protection from toxic forms of oxygen must rely on eliminating superoxide and hydrogen peroxide.

In yeast, to counteract damage of oxidative stress, there are several antioxidant systems with an apparent functional redundancy. For example, there are detoxifying enzymes such as catalases, cytochrome c peroxidase, glutathione peroxidases, glytaredoxins and peroxiredoxins, and many isoforms in distinct cellular compartments (Jamieson et al., 1998, *Yeast*. 14:1511-1527; Grant et al., 2001, *Mol. Microbiol* 39:533-541; Collinson et al., 2003, *J. Biol. Chem.* 278:22492-22497; Park et al., 2000, *J. Biol. Chem.* 275:5723-5732).

As described above, an enzyme involved in the isobutanol production pathway, dihydroxyacid dehydratase (DHAD), contains an iron-sulfur (FeS) cluster domain. This iron-sulfur (FeS) cluster domain is sensitive to damage by ROS, which can lead to inactive enzyme. Both 2Fe-2S and 4Fe-4S DHAD enzymes may be susceptible to inactivation by ROS, however direct evidence exists for inactivation of 4Fe-4S cluster containing proteins, such as homoaconitase and isopropylmalate dehydratase in yeast and DHAD and fumarase from *E. coli*. Therefore, to achieve a functional DHAD expressed in the yeast cytosol in an environment where a substantial amount of ROS may exist from respiration, it may be beneficial to protect the DHAD enzyme from ROS inactivation or oxidative stress through expression of on or more enzymes that reduce or eliminate ROS from the cell.

To mitigate the potential harmful effects of reactive oxygen species (ROS) or oxidative stress on DHAD in the yeast cytosol, the present inventors have devised several strategies to protect or repair the DHAD from ROS damage. In various embodiments described herein, the invention provides recombinant microorganisms that have been engineered to express one or more proteins in the cytosol that reduce the concentration of reactive oxygen species (ROS) in said cytosol.

In one embodiment, enzymes that reduce or eliminate the amount of ROS in the cytosol are expressed and targeted to the yeast cytosol. Specifically, enzymes such as catalase, superoxide dismutase (SOD), cytochrome c peroxidase, glutathione peroxidases, glytaredoxins, peroxiredoxins, metallothioneins, and methionine sulphoxide reductases, or any isoforms thereof are expressed, such that they lead to reduction in ROS such as hydrogen peroxide, superoxide, peroxide. radicals, and other ROS in the yeast cytosol.

In one embodiment, a catalase is expressed to reduce the concentration of ROS in the cytosol. In another embodiment, a superoxide dismutase (SOD) is expressed to reduce the concentration of ROS in the cytosol. Usually, microbes that grow by aerobic respiration possess one or both of SOD and catalase. For example, the bacterium *E. coli* and the yeast *Saccharomyces cerevisiae* each possesses at least one native SOD and catalase (e.g., SOD1 or SOD2 from yeast). In *E. coli*, the genes katG and katE encode catalase enzymes, and the genes sodA, sodB and sodC encode SodA, SodB, and SodC superoxide dismutase enzymes respectively. In *S. cerevisiae*, the genes CTT1 and CTA1 encode catalase CTT1 and CTA1 enzymes, and the genes SOD1 and SOD2 encode SOD1 and SOD2 superoxide dismutase enzymes. Many other organisms possess catalase and SOD enzymes and these genes may also be useful for reduction of ROS in the yeast cytosol. In one embodiment, SOD homologs from species other than *E. coli* or yeast can be expressed in yeast cytosol to reduce oxidative stress. In one embodiment, said other species is a plant or a fungus. For example, SOD1 from *N. crassa* (fungus) may be functionally expressed in the yeast cytosol. In various embodiments described herein, active variants or homologs of the above-described catalases and SODs can be functionally expressed in the yeast cytosol. In another embodiment, protein having a homology to any one of the catalases or SODs described above possessing at least about 70%, at least about 80%, or at least about 90% similarity can be functionally expressed in the yeast cytosol.

In one embodiment, the catalase genes from *E. coli* are expressed in and targeted to the cytosol of yeast to reduce the amount of ROS and increase the activity of DHAD also expressed in and targeted to the yeast cytosol. In another embodiment, the catalase genes from *S. cerevisiae* are overexpressed in and targeted to the cytosol of yeast to reduce the amount of ROS and increase the activity of DHAD also expressed in and targeted to the yeast cytosol. In one embodiment, the SOD genes from *E. coli* are expressed in and targeted to the cytosol of yeast to reduce the amount of ROS and increase the activity of DHAD also expressed in and targeted to the yeast cytosol. In another embodiment, the SOD genes from *S. cerevisiae* are expressed in and targeted to the cytosol of yeast to reduce the amount of ROS and increase the activity of DHAD also expressed in and targeted to the yeast cytosol. In another embodiment, promoters of native genes are altered, such that the level of SOD or catalase in the *S. cerevisiae* cytosol is increased. In yet another embodiment, expression of SOD or catalase in the yeast cytosol is mediated by a plasmid. In yet another embodiment, expression of SOD or catalase in the yeast cytosol is mediated by expression of one or more copies of the gene from the chromosome. Other homologs of catalase or SOD may be identified by one skilled in the art through tools such as BLAST and sequence alignment. These other homologs may be expressed in a similar manner described above to achieve a functional catalase or SOD in the yeast cytosol.

In another embodiment, a methionine sulphoxide reductase enzyme is expressed to reduce the amount of ROS and protect DHAD from ROS damage and inactivation. In one embodiment, the methionine sulphoxide reductase may be derived from a eukaryotic organism (e.g., a yeast, fungus, or plant). In another embodiment, the methionine sulphoxide reductases may be derived from a prokaryotic organism (e.g., *E. coli*). The principal enzymatic mechanism for reversing protein oxidation acts on the oxidation product of just one amino acid residue, methionine. This specificity for Met reflects the fact that Met is particularly susceptible to oxidation compared with other amino acids. Methionine sulphoxide reductases (MSRs) are conserved across nearly all organisms from bacteria to humans, and have been the focus of considerable attention in recent years. Two MSR activities have been characterized in the yeast *Saccharomyces cerevisiae*: MsrA (encoded by MXR1) reduces the S stereoisomer of methionine sulphoxide (MetO), while MsrB (encoded by the YCL033c ORF), which we term here MXR2) reduces the R stereoisomer of MetO. Consistent with defense against oxidative damage, mutants deficient in MSR activity are hypersensitive to pro-oxidants such as $H_2O_2$, paraquat and Cr, while MSR overexpression enhances resistance. Besides methionine residues, iron-sulfur (FeS) clusters are exquisitely ROS-sensitive components of many cellular proteins. It has been reported that MSR activity helps to preserve the function of cellular FeS clusters.

In one embodiment, the methionine sulphoxide reductase genes from *S. cerevisiae* are expressed in and targeted to the cytosol of yeast to reduce the amount of ROS and increase the activity of DHAD also expressed in and targeted to the yeast cytosol. Specifically, the *S. cerevisiae* methionine sulphoxide reductase genes MsrA (encoded by MXR1) and MsrB (encoded by the YCL033c ORF) are expressed in and targeted to the cytosol of yeast to reduce the amount of ROS and increase the activity of DHAD also expressed in and targeted to the yeast cytosol. The resulting methionine sulphoxide reductase expressing strain will generally demonstrate improved isobutanol productivity, titer, and/or yield compared to the parental strain that does not comprise methionine sulphoxide reductase genes that are expressed in and targeted to the cytosol. Methionine sulphoxide reductases from other organisms, such as bacteria, may be identified by sequence homology using tools such as BLAST and pairwise sequence alignments by one skilled in the art.

In yet another embodiment, expression or overexpression of glutathione synthesis enzymes, for example GSH1, leads to increased glutathione in the cell and protection of the DHAD enzyme in the yeast cytosol. In one embodiment, said enzymes are derived from a bacteria (e.g., *E. coli*). In another embodiment, said enzymes are derived from yeast (e.g., *S. cerevisiae*). In yet another embodiment, said enzymes are derived from a yeast species different from the yeast used for isobutanol production.

In one embodiment, one or more metallothionein proteins are expressed in the yeast cytosol to mitigate oxidative stress. Metallothioneins are a family of proteins found in many organisms including yeast and mammals. The biologic function of metallothionein (MT) has been a perplexing topic ever since the discovery of this protein. Many studies have suggested that MT plays a role in the homeostasis of essential metals such as zinc and copper, detoxification of toxic metals such as cadmium, and protection against oxidative stress. MT contains high levels of sulfur. The mutual affinity of sulfur for transition metals makes the binding of these metals to MT thermodynamically stable. Under physiologic conditions, zinc-MT is the predominant form of the metal-binding protein. However, other metals such as copper (Cu) are also bound by MT. Oxidation of the thiolate cluster by a number of mild cellular oxidants causes metal release and formation of MT-disulfide (or thionin if all metals are released from MT, but this is unlikely to occur in vivo), which have been demonstrated in vivo. MT-disulfide can be reduced by glutathione in the presence of selenium catalyst, restoring the capacity of the protein to bind metals like Zn and Cu. This MT redox cycle may play a crucial role in MT biologic function. It may link to the homeostasis of essential metals, detoxification of toxic metals and protection against oxidative stress. In fact, MT has been shown to substitute for superoxide dismutase in yeast cells in the presence of Cu to protect cells and proteins from oxidative stress.

In one embodiment, said metallothuineins are derived from a eukaryotic organism (e.g., a yeast, fungus, or plant). In another embodiment, said metallothuineins are derived from a prokaryotic organism (e.g., *E. coli, Mycobacterium tuberculosis*). For example, the metallothionein genes CUP1-1 and CUP1-2 encoding metallothionein CUP1 from *S. cerevisiae*, active variants thereof, homologs thereof, or combination thereof are expressed in and targeted to the cytosol of yeast to reduce the amount of ROS and increase the activity of DHAD also expressed in and targeted to the yeast cytosol. In another embodiment, *S. cerevisiae* metallothionein genes CUP1-1 and CUP1-2 are expressed in and targeted to the cytosol of yeast to reduce the amount of ROS and increase the activity of DHAD also expressed in and targeted to the yeast cytosol. In another embodiment, *Mycobacterium tuberculosis* metallothionein gene MymT encoding metallothionein is expressed in and targeted to the cytosol of yeast to reduce the amount of ROS and increase the activity of DHAD that is also expressed in and targeted to the yeast cytosol. In another embodiment, *Synechococcus* PCC 7942 metallothionein gene SmtA is expressed in and targeted to the cytosol of yeast to reduce the amount of ROS and increase the activity of DHAD that is also expressed in and targeted to the yeast cytosol. The resulting metallothionein expressing strain has improved isobutanol productivity, titer, and/or yield compared to the parental strain. Metallothioneins from other organisms, such as bacteria, may be identified by sequence homology using tools such as BLAST and pairwise sequence alignments by one skilled in the art.

In another embodiment, one or more proteins in the thioredoxin system and/or the glutathione/glutaredoxin system, active variants thereof, homologs thereof, or combination thereof are expressed in the yeast cytosol to mitigate oxidative stress. In one embodiment, said proteins in the thioredoxin system and/or the glutathione/glutaredoxin system are derived from a eukaryotic organism (e.g., a yeast, fungus, or plant). In another embodiment, said proteins in the thioredoxin system and/or the glutathione/glutaredoxin system are derived from a prokaryotic organism (e.g., E. coli). The thioredoxin system and the glutathione/glutaredoxin system help maintain the reduced environment of the cell and play significant roles in defending the cell against oxidative stress. Glutathione is the major protective small molecule against oxidative stress in Saccharomyces cerevisiae. Glutathione, the tripeptide γ-glutamyl-cysteinyl-glycine, makes up the major free thiol pool present in millimolar concentrations in aerobic cells. The biosynthesis of glutathione requires γ-glutamyl cysteine synthase (termed Gsh1p) glutathione synthase (Gsh2p) and ATP. Glutathione is essential for viability of yeast but not of bacteria such as E. coli. Yeast cells lacking Gsh1p (genotype gsh1Δ) are able to survive in the presence of an external source of glutathione. Deletion of the GSH1 gene encoding the enzyme that catalyzes the first step of glutathione biosynthesis leads to growth arrest, which can be relieved by either glutathione or reducing agents such as dithiothreitol. Evidence suggests that glutathione, in addition to its protective role against oxidative damage, performs a novel and specific function in the maturation of cytosolic Fe/S proteins. Therefore, increasing the levels of glutathione in the yeast cytosol is predicted to protect or increase the steady-state levels of active FeS cluster containing proteins expressed in the yeast cytosol. Specifically, increasing glutathione within the yeast cytosol may increase the amount of active DHAD enzyme expressed in the yeast cytosol, thereby leading to an increase in the titer, productivity, and/or yield of isobutanol produced from the pathway within which DHAD participates (e.g. the isobutanol pathway in FIG. 1).

Thioredoxins and glutaredoxins are small heat-stable proteins with redox-active cysteines that facilitate the reduction of other proteins by catalyzing cysteine thiol-disulfide exchange reactions. The glutathione/glutaredoxin system consists of glutaredoxin, glutathione (produced by glutathione synthase), glutathione reductase and NADPH (as an electron donor). Thus, to increase the effective levels of available glutathione, one or a combination of each of the following enzymes is functionally overexpressed in the yeast cytosol: glutaredoxin (encoded in S. cerevisiae by GRX2, GRX4, GRX6, and GRX7), glutathione reductase (encoded in S. cerevisiae by GLR1); and glutathione synthase (encoded in S. cerevisiae by GSH1 and GSH2). In one embodiment, homologs thereof, active variants thereof, or combination thereof can be expressed in the yeast cytosol to mitigate oxidative stress.

In another embodiment, the γ-glutamyl cysteine synthase and glutathione synthase genes from S. cerevisiae are expressed in and targeted to the cytosol of yeast to increase the amount of glutathione and increase the activity of DHAD also expressed in and targeted to the yeast cytosol. In another embodiment, S. cerevisiae γ-glutamyl cysteine synthase and glutathione synthase genes Gsh1 and Gsh2 are expressed in and targeted to the cytosol of yeast to increase the amount of glutathione and increase the activity of DHAD also expressed in and targeted to the yeast cytosol. The resulting γ-glutamyl cysteine synthase and glutathione synthase expressing strain has improved isobutanol productivity, titer, and/or yield compared to the parental strain. Homologous genes encoding γ-glutamyl cysteine synthase and glutathione synthase from other organisms, such as other yeast strains, may be identified by sequence homology using tools such as BLAST and pairwise sequence alignments by one skilled in the art.

Thioredoxins contain two conserved cysteines that exist in either a reduced form as in thioredoxin-$(SH)_2$ or in an oxidized form as in thioredoxin-$S_2$ when they form an intramolecular disulfide bridge. Thioredoxins donate electrons from their active center dithiol to protein disulfide bonds (Protein-$S_2$) that are then reduced to dithiols (Protein-$(SH)_2$). The resulting oxidized thioredoxin disulfide is reduced directly by thioredoxin reductase with electrons donated by NADPH. Hence the thioredoxin reduction system consists of thioredoxin, thioredoxin reductase, and NADPH. Oxidized glutaredoxins, on the other hand, are reduced by the tripeptide glutathione (gamma-Glu-Cys-Gly, known as GSH) using electrons donated by NADPH. Hence the glutathione/glutaredoxin system consists of glutaredoxin, glutathione, glutathione reductase and NADPH.

S. cerevisiae contains a cytoplasmic thioredoxin system comprised of the thioredoxins Trx1p and Trx2p and the thioredoxin reductase Trr1p, and a complete mitochondrial thioredoxin system comprised of the thioredoxin Trx3p and the thioredoxin reductase Trr2p. Evidence suggests that the cytoplasmic thioredoxin system may have overlapping function with the glutathione/glutaredoxin system. The mitochondrial thioredoxin system, on the other hand, does not appear to be able to substitute for either the cytoplasmic thioredoxin or glutathione/glutaredoxin systems. Instead, the mitochondrial thioredoxin proteins, thioredoxin (Trx3p) and thioredoxin reductase (Trr2p) have been implicated in the defense against oxidative stress generated during respiratory metabolism.

Overexpression of the essential cytosolic functional components of the thioredoxin system is thus predicted to increase the amount of bioavailable cytosolic thioredoxin, resulting in a significant increase in cellular redox buffering potential and concomitant increase in stable, active cytosolic FeS clusters and DHAD activity. Thus, one or more of the following genes are expressed either singly or in combination, thereby resulting in a functional increase in available thioredoxin: a thioredoxin (encoded in S. cerevisiae by TRX1 and TRX2) and a thioredoxin reductase (encoded in S. cerevisiae by TRR1). Separately, or in combination with the aforementioned genes, the mitochondrial thioredoxin system (encoded by thioredoxin gene TRX3 and thioredoxin reductase gene TRR2) are overexpressed, and, although functional in the mitochondria, provide an added or synergistic effect on FeS cluster assembly or stability, as assayed by increased DHAD activity and/or output of isobutanol in a fermentation. Overexpression of these genes may be accomplished by methods as described above. In one embodiment, active variants of any one of the aforementioned thioredoxins or thioredoxin reductases, homologs thereof, or combination thereof are expressed in the yeast cytosol to mitigate oxidative stress.

Enhancing Cytosolic DHAD Activity by Mitigating Stress Mediated by Reactive Nitrogen Species (RNS)

Nitric oxide and reactive nitrogen species are highly reactive, short-lived molecules that can be generated during periods of cellular stress. The exact mechanisms by which these molecules are created, or their downstream targets, is not completely understood and is the subject of intense investigation. However, the functional groups present in many proteins—for example, FeS clusters—are readily attacked and inactivated by NO/RNS. Loss of these labile functional groups usually results in an inactive enzyme.

Nitric oxide and reactive nitrogen species are highly reactive, short-lived molecules that can be generated during normal cellular function, respiration, and during periods of cellular or redox stress. RNS are produced in eukaryotic cells starting with the reaction of nitric oxide (.NO) with superoxide (O2.-) to form peroxynitrite (ONOO—):

.NO (nitric oxide)+O2.-(super oxide)→ONOO—(peroxynitrite)

Peroxynitrite itself is a highly reactive species which can directly react with various components of the cell. Alternatively peroxynitrite can react with other molecules to form additional types of RNS including nitrogen dioxide ($NO_2O_3$) and dinitrogen trioxide ($N_2O_3$) as well as other types of chemically reactive radicals. Important reactions involving RNS include:

ONOO—+H+→ONOOH (peroxynitrous acid)→.$NO_2$ (nitrogen dioxide)+.OH(hydroxyl radical)

ONOO—+$CO_2$(carbon dioxide)→ONOO$CO_2$—(nitrosoperoxycarbonate)

ONOO$CO_2$—→.$NO_2$(nitrogen dioxide)+O═C(O.) O—(carbonate radical).NO+.$NO_2$ is in equilibrium with $N_2O_3$(dinitrogen trioxide)

NO exhibits other types of interaction that are candidates for mediating aspects of its physiological action. Notably, in a process known as nitrosylation, or nitrosation, NO can modify free sulfhydryl (thiol) groups of cysteines in proteins to produce nitrosothiols, SNOs. Transfer of the NO adduct from one sulfydryl to another transnitrosylation) is likely to play a signal transduction role (reviewed in Stamler et al., 2001). Study of this post-translational modification, which is proposed to be a widespread mediator of signaling, is a relatively new field, and the list of proteins that are modified through nitrosylation is expanding rapidly. Because NO is highly reactive, transport of an NO signal in tissues can be facilitated through reaction with glutathione and movement of the resulting S-nitrosoglutathione (GSNO), which can subsequently signal by modifying thiol groups on target proteins by transnitrosylation (Lipton et al., 2001; Foster et al., 2003). The discovery of GSNO reductase (GSNOR), which reduces GSNO to restore GSH and to eliminate the NO adduct as $NH^{4+}$ (Jensen et al., 1998), revealed the importance of the control of this NO metabolite.

The exact mechanisms by which the aforementioned molecules are generated, or their downstream targets, are not completely understood and are the subject of intense investigation. However, the functional groups present in many proteins—for example, FeS clusters—are readily attacked by NO/RNS. The enzyme dihydroxyacid dehydratase (DHAD) contains an iron-sulfur (FeS) cluster cofactor that is sensitive to damage by NO or RNS. As an example of the biological sensitivity of this class of enzyme to attack by NO/RNS, inactivation of the *E. coli* DHAD (encoded by IlvD) and subsequent bacterial cell death resulting from macrophage-generated NO is a major component of the mammalian humoral immune response.

The present invention provides methods of mitigating the potentially harmful effects of oxidative and nitrosative stress (e.g., NO and/or or RNS) on enzymes involved in the production of isobutanol in the yeast cytosol. Specifically, the enzyme dihydroxyacid dehydratase (DHAD) contains an iron-sulfur (Fe—S) cluster that is sensitive to damage by NO and/or RNS, leading to inactive enzyme. Strategies of mitigating such harmful effects include, but are not limited to, increasing repair of iron-sulfur clusters damaged by oxidative and nitrosative stress conditions; reducing nitric oxide levels by introduction of a nitric oxide reductase (NOR) activity in the cell; reducing the levels of SNO's by overexpression of a GSNO-reductase; or combination thereof.

Strategies disclosed herein are intended to protect or repair DHAD from NO/RNS damage. Accordingly, in one embodiment, the present invention provides recombinant microorganisms that have been engineered to express one or more enzymes in the cytosol that reduce the concentration of reactive nitrogen species (RNS) and/or nitric oxide in said cytosol.

In one embodiment, the present invention provides recombinant microorganisms that have been engineered to express a nitric oxide reductase that reduce the concentration of reactive nitrogen species (RNS) and/or nitric oxide in said cytosol. To reduce nitric oxide levels in the yeast cytosol, one or more nitric oxide reductases (NORs) or active variants thereof can be introduced into the cell by overexpression. Genes present in several microbial species have been shown to encode a nitric oxide reductase activity. For example, in *E. coli* the gene for a flavourubredoxin, norV, encodes a flavodiiron NO reductase that is one of the most highly induced genes when *E. coli* cells are exposed to NO or GSNO. Previous work has identified a gene present in the microbe *Fusarium oxysporum* as encoding a cytochrome P-450 55A1 (P-450dNIR) that encodes a nitric oxide reductase (Nakahara et al., 1993, *J. Biol. Chem.* 268:8350-8355). When expressed in a eukaryotic cell, this gene product appears to be cytosolically localized and exhibits effects consistent with its reducing intracellular NO levels (Dijkers et al., 2009, *Molecular Biology of the Cell*, 20: 4083-4090). Thus, in one embodiment, homologs of any above-described nitric oxide reductases, active variants thereof, or combinations thereof are expressed in the yeast cytosol to mitigate nitric oxide.

In contrast to *E. coli* and *F. oxysporum*, *S. cerevisiae* lacks an endogenous NOR activity (and no homologs of either NOR protein is found in the *S. cerevisiae* genome). Thus, to provide such an activity, the *F. oxysporum* NOR gene is synthesized or amplified from genomic DNA, or the *E. coli* norV gene is amplified from genomic DNA, and either (or both) cloned into a suitable yeast expression vector. Such a vector could either be high copy (e.g., 2 micron origin) or low copy (CEN/ARSH), or a single or multiple copies of the gene could be stably integrated into the genome of a host organism, specifically a yeast containing a cytosolic isobutanol pathway. In each case, methods to clone a gene into a plasmid so that it is expressed at a desired level under the control of a known yeast promoter (including those steps required to transform a host yeast cell) are well known to those skilled in the art. In those cases where the NOR gene is expressed from an episomal plasmid, it can be advantageous to simultaneous overexpress a desired DHAD gene, either from the same or from another plasmid, thereby allowing one to assay the resulting output in DHAD activity. Similar approaches are undertaken to express the NOR gene in the presence of a plasmid(s) encoding an isobutanol production pathway, where the results of NOR expression are manifested in changes in isobutanol productivity, titer, or yield. It is understood by one skilled in the art that expression of all genes, both NOR and genes encoding the isobutanol pathway may be integrated into the genome of a host organism in a single or multiple copies of the gene(s), specifically a yeast containing a cytosolic isobutanol pathway.

In another embodiment, the present invention provides recombinant microorganisms that have been engineered to express a glutathione-S-nitrosothiol reductase (GSNO-reductase) that reduces the concentration of reactive nitrogen species (RNS) and/or nitric oxide in said cytosol. To reduce the levels of SNO's, one or more GSNO-reductases or active variants thereof can be introduced into the cell by overexpression. In *S. cerevisiae*, the gene SFA1 has been shown to encode a formaldehyde dehydrogenase that possesses GSNO reductase activity (Liu et al., 2001, *Nature* 410:490-494). Sfa1p is a member of the class III alcohol dehydrogenases (EC:1.1.1.284), which are bifunctional enzymes containing both alcohol dehydrogenase and glutathione-dependent formaldehyde dehydrogenase activities. The glutathione-dependent formaldehyde dehydrogenase activity of Sfa1p is required for the detoxification of formaldehyde, and the alcohol dehydrogenase activity of Sfa1p can catalyze the final reactions in phenylalanine and tryptophan degradation. Sfa1p is also able to act as a hydroxymethylfurfural (HMF) reductase and catabolize HMF, a compound formed in the production of certain biofuels. Sfa1p has been localized to the cytoplasm and the mitochondria, and can act on a variety of substrates, including S-hydroxymethylglutathione, phenylacetaldehyde, indole acetaldehyde, octanol, 10-hydroxydecanoic acid, 12-hydroxydodecanoic acid, and S-nitrosoglutathione.

Sfa1 protein levels are reported as being low-to-moderate from proteome-wide analyses (Ghaemmaghami et al., 2003, *Nature* 425(6959):737-41). Thus, in an analogous fashion to the approach described for overexpression of NOR, the gene SFA1 is overexpressed, thereby decoupling it from its normal regulatory control and permitting significant increase in Sfa1 activity in the cell, which results in measurable increases in DHAD activity and/or fermentation output, as described above. Overexpression of these genes may be accomplished by methods as described above. In one embodiment, homologs of SFA1, active variants thereof, or combinations thereof are expressed in the yeast cytosol to mitigate stresses brought on by reactive nitrogen species.

In additional embodiments, alternative enzymes may be expressed and targeted to the yeast cytosol containing the isobutanol pathway to mitigate the effects of reactive nitrogen species. Specifically, the enzyme YtfE encoded by *E. coli* ytfE, homologs thereof, active variants thereof, may be expressed, such that they lead to reduction in NO/RNS in the yeast cytosol and/or a concomitant increase in DHAD function. Such an increase is detected by in vitro assay of DHAD activity, and/or by an increase in productivity, titer, or yield of isobutanol produced by isobutanol pathway-containing cells.

To increase repairment of iron-sulfur clusters, in one embodiment, the gene ytfE from *E. coli* is expressed in the yeast cytosol which contains a functional isobutanol pathway and DHAD such that DHAD activity and/or isobutanol productivity, titer, or yield are increased from the yeast cells. In *E. coli*, the gene ytfE has been shown to play an important role in maintaining active Fe—S clusters. A recent report (Justino et al., (2009). *Escherichia coli* Di-iron YtfE protein is necessary for the repair of stress-damaged Iron-Sulfur Clusters. *JBC* 282(14): 10352-10359) showed that ΔytfE strains have several phenotypes, including enhanced susceptibility to nitrosative stress and are defective in the activity of several iron-sulfur-containing proteins. For example, the damage of the $[4Fe-4S]^{2+}$ clusters of aconitase B and fumarase A caused by exposure to hydrogen peroxide and nitric oxide stress occurs at higher rates in the absence of ytfE. The ytfE null mutation also abolished the recovery of aconitase and fumarase activities, which is observed in wild-type *E. coli* once the stress is scavenged. Notably, upon the addition of purified holo-YtfE protein to mutant cell extracts, the enzymatic activities of fumarase and aconitase were fully recovered, and at rates similar to the wild-type strain. Thus, YtfE is critical for the repair of iron-sulfur clusters damaged by oxidative and nitrosative stress conditions, and presents an attractive candidate for overexpression in a host cell that normally lacks this activity, such as *S. cerevisiae*, where Fe—S cluster proteins are also being overexpressed as part of the isobutanol pathway.

To provide such an activity, the *E. coli* ytfE gene can be amplified from genomic DNA by PCR with appropriate primers, and cloned into a suitable yeast expression vector. Such a vector could either be high copy (e.g., 2 micron origin) or low copy (CEN/ARS), or a single or multiple copies of the gene could be stably integrated into the genome of a host organism. In each case, methods to clone a gene into a plasmid so that it is expressed at a desired level under the control of a known yeast promoter (including those steps required to transform a host yeast cell) are well known to those skilled in the art. In those cases where the ytfE gene is expressed from an episomal plasmid, it can be advantageous to simultaneously overexpress a desired DHAD gene, either from the same or from another plasmid, thereby allowing one to assay the resulting output in DHAD activity. Similar approaches are undertaken to express the ytfE gene in the presence of a plasmid(s) encoding an isobutanol production pathway, where the results of ytfE expression are manifested in changes in isobutanol productivity, titer, or yield. More specifically, ytfE is expressed in the yeast cytosol which contains a functional isobutanol pathway and DHAD such that DHAD activity and/or isobutanol productivity, titer, or yield are increased from the yeast cells.

In addition, functional homologs of *E. coli* ytfE have been identified and characterized. For example, genes from two pathogenic prokaryotes—scdA from *Staphylococcus aureus*, and dnrN from *Neisseria gonorrhoeae*, have been shown to have properties similar to that of ytfE (Overton, T. W., et al (2008). Widespread distribution in pathogenic bacteria of di-iron proteins that repair oxidative and nitrosative damage to iron-sulfur centers. *J. Bacteriology* 190(6): 2004-2013). Thus, similar approaches to overexpress either of these genes are employed, as described for *E. coli* ytfE, above. Overexpression of these genes may be accomplished by methods as described above.

The Microorganism in General

The recombinant microorganisms provided herein can express a plurality of heterologous and/or native target enzymes involved in pathways for the production of beneficial metabolites such as isobutanol, 3-methyl-1-butanol, 2-methyl-1-butanol, valine, isoleucine, leucine, and pantothenic acid from a suitable carbon source.

Accordingly, "engineered" or "modified" microorganisms are produced via the introduction of genetic material into a host or parental microorganism of choice and/or by modification of the expression of native genes, thereby modifying or altering the cellular physiology and biochemistry of the microorganism. Through the introduction of genetic material and/or the modification of the expression of native genes the parental microorganism acquires new properties, e.g. the ability to produce a new, or greater quantities of, an intracellular metabolite. As described herein, the introduction of genetic material into and/or the modification of the expression of native genes in a parental microorganism results in a new or modified ability to produce beneficial metabolites such as isobutanol, 3-methyl-1-butanol, 2-methyl-1-butanol, valine, isoleucine, leucine, and pantothenic acid from a suitable carbon source. The genetic material introduced into and/or the genes modified for expression in the parental microorganism contains gene(s), or parts of genes, coding for one or more of the enzymes involved in a biosynthetic pathway for the production of one or more metabolites selected from isobutanol, 3-methyl-1-butanol, 2-methyl-1-butanol, valine, isoleucine, leucine, and pantothenic acid and may also include additional elements for the expression and/or regulation of expression of these genes, e.g. promoter sequences.

In addition to the introduction of a genetic material into a host or parental microorganism, an engineered or modified microorganism can also include alteration, disruption, deletion or knocking-out of a gene or polynucleotide to alter the cellular physiology and biochemistry of the microorganism. Through the alteration, disruption, deletion or knocking-out of a gene or polynucleotide the microorganism acquires new or improved properties (e.g., the ability to produce a new metabolite or greater quantities of an intracellular metabolite, improve the flux of a metabolite down a desired pathway, and/or reduce the production of byproducts).

Recombinant microorganisms provided herein may also produce metabolites in quantities not available in the parental microorganism. A "metabolite" refers to any substance produced by metabolism or a substance necessary for or taking part in a particular metabolic process. A metabolite can be an organic compound that is a starting material (e.g., glucose or pyruvate), an intermediate (e.g., 2-ketoisovalerate), or an end product (e.g., isobutanol) of metabolism. Metabolites can be used to construct more complex molecules, or they can be broken down into simpler ones. Intermediate metabolites may be synthesized from other metabolites, perhaps used to make more complex substances, or broken down into simpler compounds, often with the release of chemical energy.

The disclosure identifies specific genes useful in the methods, compositions and organisms of the disclosure; however it will be recognized that absolute identity to such genes is not necessary. For example, changes in a particular gene or polynucleotide comprising a sequence encoding a polypeptide or enzyme can be performed and screened for activity. Typically such changes comprise conservative mutations and silent mutations. Such modified or mutated polynucleotides and polypeptides can be screened for expression of a functional enzyme using methods known in the art.

Due to the inherent degeneracy of the genetic code, other polynucleotides which encode substantially the same or functionally equivalent polypeptides can also be used to clone and express the polynucleotides encoding such enzymes.

As will be understood by those of skill in the art, it can be advantageous to modify a coding sequence to enhance its expression in a particular host. The genetic code is redundant with 64 possible codons, but most organisms typically use a subset of these codons. The codons that are utilized most often in a species are called optimal codons, and those not utilized very often are classified as rare or low-usage codons. Codons can be substituted to reflect the preferred codon usage of the host, a process sometimes called "codon optimization" or "controlling for species codon bias."

Optimized coding sequences containing codons preferred by a particular prokaryotic or eukaryotic host (Murray et al., 1989, *Nucl Acids Res.* 17: 477-508) can be prepared, for example, to increase the rate of translation or to produce recombinant RNA transcripts having desirable properties, such as a longer half-life, as compared with transcripts produced from a non-optimized sequence. Translation stop codons can also be modified to reflect host preference. For example, typical stop codons for *S. cerevisiae* and mammals are UM and UGA, respectively. The typical stop codon for monocotyledonous plants is UGA, whereas insects and *E. coli* commonly use UAA as the stop codon (Dalphin et al., 1996, *Nucl Acids Res.* 24: 216-8). Methodology for optimizing a nucleotide sequence for expression in a plant is provided, for example, in U.S. Pat. No. 6,015,891, and the references cited therein.

Those of skill in the art will recognize that, due to the degenerate nature of the genetic code, a variety of DNA compounds differing in their nucleotide sequences can be used to encode a given enzyme of the disclosure. The native DNA sequence encoding the biosynthetic enzymes described above are referenced herein merely to illustrate an embodiment of the disclosure, and the disclosure includes DNA compounds of any sequence that encode the amino acid sequences of the polypeptides and proteins of the enzymes utilized in the methods of the disclosure. In similar fashion, a polypeptide can typically tolerate one or more amino acid substitutions, deletions, and insertions in its amino acid sequence without loss or significant loss of a desired activity. The disclosure includes such polypeptides with different amino acid sequences than the specific proteins described herein so long as they modified or variant polypeptides have the enzymatic anabolic or catabolic activity of the reference polypeptide. Furthermore, the amino acid sequences encoded by the DNA sequences shown herein merely illustrate embodiments of the disclosure.

In addition, homologs of enzymes useful for generating metabolites are encompassed by the microorganisms and methods provided herein.

As used herein, two proteins (or a region of the proteins) are substantially homologous when the amino acid sequences have at least about 30%, 40%, 50% 60%, 65%, 70%, 75%, 80%, 85%, 90%, 91%, 92%, 93%, 94%, 95%, 96%, 97%, 98%, or 99% identity. To determine the percent identity of two amino acid sequences, or of two nucleic acid sequences, the sequences are aligned for optimal comparison purposes (e.g., gaps can be introduced in one or both of a first and a second amino acid or nucleic acid sequence for optimal alignment and non-homologous sequences can be disregarded for comparison purposes). In one embodiment, the length of a reference sequence aligned for comparison purposes is at least 30%, typically at least 40%, more typically at least 50%, even more typically at least 60%, and even more typically at least 70%, 80%, 90%, 100% of the length of the reference sequence. The amino acid residues or nucleotides at corresponding amino acid positions or nucleotide positions are then compared. When a position in the first sequence is occupied by the same amino acid residue or nucleotide as the corresponding position in the second sequence, then the molecules are identical at that position (as used herein amino acid or nucleic acid "identity" is equivalent to amino acid or nucleic acid "homology"). The percent identity between the two sequences is a function of the number of identical positions shared by the sequences, taking into account the number of gaps, and the length of each gap, which need to be introduced for optimal alignment of the two sequences.

When "homologous" is used in reference to proteins or peptides, it is recognized that residue positions that are not identical often differ by conservative amino acid substitutions. A "conservative amino acid substitution" is one in which an amino acid residue is substituted by another amino acid residue having a side chain (R group) with similar chemical properties (e.g., charge or hydrophobicity). In general, a conservative amino acid substitution will not substantially change the functional properties of a protein. In cases where two or more amino acid sequences differ from each other by conservative substitutions, the percent sequence identity or degree of homology may be adjusted upwards to correct for the conservative nature of the substitution. Means for making this adjustment are well known to those of skill in the art (See, e.g., Pearson W. R., 1994, *Methods in Mol Biol* 25: 365-89.

The following six groups each contain amino acids that are conservative substitutions for one another. 1) Serine (S), Threonine (T); 2) Aspartic Acid (D), Glutamic Acid (E); 3) Asparagine (N), Glutamine (Q); 4) Arginine (R), Lysine (K); 5) Isoleucine (I), Leucine (L), Alanine (A), Valine (V), and 6) Phenylalanine (F), Tyrosine (Y), Tryptophan (W).

Sequence homology for polypeptides, which is also referred to as percent sequence identity, is typically measured using sequence analysis software. See commonly owned and co-pending application US 2009/0226991. A typical algorithm used comparing a molecule sequence to a database containing a large number of sequences from different organisms is the computer program BLAST. When searching a database containing sequences from a large number of different organisms, it is typical to compare amino acid sequences. Database searching using amino acid sequences can be measured by algorithms described in commonly owned and co-pending application US 2009/0226991.

It is understood that a range of microorganisms can be modified to include a recombinant metabolic pathway suitable for the production of beneficial metabolites from DHAD-requiring biosynthetic pathways. In various embodiments, microorganisms may be selected from yeast microorganisms. Yeast microorganisms for the production of a metabolite such as isobutanol, 3-methyl-1-butanol, 2-methyl-1-butanol, valine, isoleucine, leucine, and pantothenic acid may be selected based on certain characteristics:

One characteristic may include the property that the microorganism is selected to convert various carbon sources into beneficial metabolites such as isobutanol, 3-methyl-1-butanol, 2-methyl-1-butanol, valine, isoleucine, leucine, and pantothenic acid. The term "carbon source" generally refers to a substance suitable to be used as a source of carbon for prokaryotic or eukaryotic cell growth. Examples of suitable carbon sources are described in commonly owned and co-pending application US 2009/0226991. Accordingly, in one embodiment, the recombinant microorganism herein disclosed can convert a variety of carbon sources to products, including but not limited to glucose, galactose, mannose, xylose, arabinose, lactose, sucrose, and mixtures thereof.

The recombinant microorganism may thus further include a pathway for the production of isobutanol, 3-methyl-1-butanol, 2-methyl-1-butanol, valine, isoleucine, leucine, and/or pantothenic acid from five-carbon (pentose) sugars including xylose. Most yeast species metabolize xylose via a complex route, in which xylose is first reduced to xylitol via a xylose reductase (XR) enzyme. The xylitol is then oxidized to xylulose via a xylitol dehydrogenase (XDH) enzyme. The xylulose is then phosphorylated via an xylulokinase (XK) enzyme. This pathway operates inefficiently in yeast species because it introduces a redox imbalance in the cell. The xylose-to-xylitol step uses NADH as a cofactor, whereas the xylitol-to-xylulose step uses NADPH as a cofactor. Other processes must operate to restore the redox imbalance within the cell. This often means that the organism cannot grow anaerobically on xylose or other pentose sugar. Accordingly, a yeast species that can efficiently ferment xylose and other pentose sugars into a desired fermentation product is therefore very desirable.

Thus, in one aspect, the recombinant is engineered to express a functional exogenous xylose isomerase. Exogenous xylose isomerases functional in yeast are known in the art. See, e.g., Rajgarhia et al, US2006/0234364, which is herein incorporated by reference in its entirety. In an embodiment according to this aspect, the exogenous xylose isomerase gene is operatively linked to promoter and terminator sequences that are functional in the yeast cell. In a preferred embodiment, the recombinant microorganism further has a deletion or disruption of a native gene that encodes for an enzyme (e.g. XR and/or XDH) that catalyzes the conversion of xylose to xylitol. In a further preferred embodiment, the recombinant microorganism also contains a functional, exogenous xylulokinase (XK) gene operatively linked to promoter and terminator sequences that are functional in the yeast cell. In one embodiment, the xylulokinase (XK) gene is overexpressed.

In one embodiment, the microorganism has reduced or no pyruvate decarboxylase (PDC) activity. PDC catalyzes the decarboxylation of pyruvate to acetaldehyde, which is then reduced to ethanol by ADH via an oxidation of NADH to NADH+. Ethanol production is the main pathway to oxidize the NADH from glycolysis. Deletion of this pathway increases the pyruvate and the reducing equivalents (NADH) available for the DHAD-requiring biosynthetic pathway. Accordingly, deletion of PDC genes can further increase the yield of desired metabolites.

In another embodiment, the microorganism has reduced or no glycerol-3-phosphate dehydrogenase (GPD) activity. GPD catalyzes the reduction of dihydroxyacetone phosphate (DHAP) to glycerol-3-phosphate (G3P) via the oxidation of NADH to NAD+. Glycerol is then produced from G3P by Glycerol-3-phosphatase (GPP). Glycerol production is a secondary pathway to oxidize excess NADH from glycolysis. Reduction or elimination of this pathway would increase the pyruvate and reducing equivalents (NADH) available for the DHAD-requiring biosynthetic pathway. Thus, deletion of GPD genes can further increase the yield of desired metabolites.

In yet another embodiment, the microorganism has reduced or no PDC activity and reduced or no GPD activity. PDC-minus/GPD-minus yeast production strains are described in co-pending applications U.S. Ser. No. 12/343, 375 (published as US 2009/0226991), U.S. Ser. No. 12/696, 645, and U.S. Ser. No. 12/820,505, which claim priority to U.S. Provisional Application 61/016,483, all of which are herein incorporated by reference in their entireties for all purposes.

In one embodiment, the yeast microorganisms may be selected from the "*Saccharomyces* Yeast Clade", as described in commonly owned and co-pending application US 2009/0226991.

The term "*Saccharomyces* sensu stricto" taxonomy group is a cluster of yeast species that are highly related to *S. cerevisiae* (Rainieri et al., 2003, *J. Biosci Bioengin* 96: 1-9). *Saccharomyces sensu stricto* yeast species include but are not limited to *S. cerevisiae, S. cerevisiae, S. kudriavzevii, S. mikatae, S. bayanus, S. uvarum, S. carocanis* and hybrids derived from these species (Masneuf et al., 1998, *Yeast* 7: 61-72).

An ancient whole genome duplication (WGD) event occurred during the evolution of the hemiascomycete yeast and was discovered using comparative genomic tools (Kellis et al., 2004, *Nature* 428: 617-24; Dujon et al., 2004, *Nature* 430:35-44; Langkjaer et al., 2003, *Nature* 428: 848-52; Wolfe et at., 1997, *Nature* 387: 708-13). Using this major evolutionary event, yeast can be divided into species that diverged from a common ancestor following the WGD event (termed "post- WGD yeast" herein) and species that diverged from the yeast lineage prior to the WGD event (termed "pre-WGD yeast" herein).

Accordingly, in one embodiment, the yeast microorganism may be selected from a post-WGD yeast genus, including but not limited to *Saccharomyces* and *Candida*. The favored post-WGD yeast species include: *S. cerevisiae, S. uvarum, S. bayanus, S. paradoxus, S. castelli*, and *C. glabrata*.

In another embodiment, the yeast microorganism may be selected from a pre-whole genome duplication (pre-WGD) yeast genus including but not limited to *Saccharomyces, Kluyveromyces, Candida, Pichia, Issatchenkia, Debaryomyces, Hansenula, Yarrowia and, Schizosaccharomyces*. Representative pre-WGD yeast species include: *S. kluyveri, K. thermotolerans, K. marxianus, K. waltii, K. lactis, C. tropicalis, P. pastoris, P. anomala, P. stipitis, I. orientalis, I. occidentalis, I. scutulata, D. hansenii, H. anomala, Y. lipolytica*, and *S. pombe*.

A yeast microorganism may be either Crabtree-negative or Crabtree-positive as described in described in commonly owned and co-pending application US 2009/0226991. In one embodiment the yeast microorganism may be selected from yeast with a Crabtree-negative phenotype including but not limited to the following genera: *Kluyveromyces, Pichia, Issatchenkia, Hansenula*, and *Candida*. Crabtree-negative species include but are not limited to: *K. lactis, K. marxianus, P. anomala, P. stipitis, I. orientalis, I. occidentalis, I. scutulata, H. anomala*, and *C. utilis*. In another embodiment, the yeast microorganism may be selected from a yeast with a Crabtree-positive phenotype, including but not limited to *Saccharomyces, Kluyveromyces, Zygosaccharomyces, Debaryomyces, Pichia* and *Schizosaccharomyces*. Crabtree-positive yeast species include but are not limited to: *S. cerevisiae, S. uvarum, S. bayanus, S. paradoxus, S. castelli, S. kluyveri; K. thermotolerans, C. glabrata, Z. bailli, Z. rouxii, D. hansenii, P. pastorius*, and *S. pombe*.

Another characteristic may include the property that the microorganism is that it is non-fermenting. In other words, it cannot metabolize a carbon source anaerobically while the yeast is able to metabolize a carbon source in the presence of oxygen. Nonfermenting yeast refers to both naturally occurring yeasts as well as genetically modified yeast. During anaerobic fermentation with fermentative yeast, the main pathway to oxidize the NADH from glycolysis is through the production of ethanol. Ethanol is produced by alcohol dehydrogenase (ADH) via the reduction of acetaldehyde, which is generated from pyruvate by pyruvate decarboxylase (PDC). In one embodiment, a fermentative yeast can be engineered to be non-fermentative by the reduction or elimination of the native PDC activity. Thus, most of the pyruvate produced by glycolysis is not consumed by PDC and is available for the isobutanol pathway. Deletion of this pathway increases the pyruvate and the reducing equivalents available for the DHAD-requiring biosynthetic pathway. Fermentative pathways contribute to low yield and low productivity of desired metabolites such as isobutanol. Accordingly, deletion of PDC may increase yield and productivity of desired metabolites such as isobutanol.

In some embodiments, the recombinant microorganisms may be microorganisms that are non-fermenting yeast microorganisms, including, but not limited to those, classified into a genera selected from the group consisting of *Tricosporon, Rhodotorula, Myxozyma*, or *Candida*. In a specific embodiment, the non-fermenting yeast is *C. xestobii*.

Isobutanol-Producing Yeast Microorganisms

As described herein, in one embodiment, a yeast microorganism is engineered to convert a carbon source, such as glucose, to pyruvate by glycolysis and the pyruvate is converted to isobutanol via an isobutanol producing metabolic pathway (See, e.g., WO/2007/050671, WO/2008/098227, and Atsumi et al., 2008, *Nature* 45: 86-9). Alternative pathways for the production of isobutanol have been described in WO/2007/050671 and in Dickinson et al., 1998, *J Biol Chem* 273:25751-6.

Accordingly, in one embodiment, the isobutanol producing metabolic pathway to convert pyruvate to isobutanol can be comprised of the following reactions:

1. 2 pyruvate→acetolactate+$CO_2$
2. acetolactate+NAD(P)H→2,3-dihydroxyisovalerate+NAD(P)$^+$
3. 2,3-dihydroxyisovalerate→alpha-ketoisovalerate
4. alpha-ketoisovalerate→isobutyraldehyde+$CO_2$
5. isobutyraldehyde+NAD(P)H→isobutanol+NADP These reactions are carried out by the enzymes 1) Acetolactate Synthase (ALS), 2) Keto-acid Reducto-Isomerase (KARI), 3) Dihydroxy-acid dehydratase (DHAD), 4) Keto-isovalerate decarboxylase (KIVD), and 5) an Alcohol dehydrogenase (ADH) (FIG. 1). In another embodiment, the yeast microorganism is engineered to overexpress these enzymes. For example, these enzymes can be encoded by native genes. Alternatively, these enzymes can be encoded by heterologous genes. For example, ALS can be encoded by the ALS gene of *B. subtilis*, alsS of *L. lactis*, or the ilvK gene of *K. pneumonia*. For example, KARI can be encoded by the ilvC genes of *E. coli, C. glutamicum, M. maripaludis*, or *Piromyces* sp E2. For example, DHAD can be encoded by the ilvD genes of *E. coli, C. glutamicum*, or *L. lactis*. For example, KIVD can be encoded by the kivD gene of *L. lactis*. ADH can be encoded by ADH2, ADH6, or ADH7 of *S. cerevisiae*.

In one embodiment, pathway steps 2 and 5 may be carried out by KAR1 and ADH enzymes that utilize NADH (rather than NADPH) as a co-factor. Such enzymes are described in commonly owned and co-pending applications U.S. Ser. No. 12/610,784 and PCT/US09/62952 (published as WO/2010/051527), which are herein incorporated by reference in their entireties for all purposes. The present inventors have found that utilization of NADH-dependent KAR1 and ADH enzymes to catalyze pathway steps 2 and 5, respectively, surprisingly enables production of isobutanol under anaerobic conditions. Thus, in one embodiment, the recombinant microorganisms of the present invention may use an NADH-dependent KAR1 to catalyze the conversion of acetolactate (+NADH) to produce 2,3-dihydroxyisovalerate. In another embodiment, the recombinant microorganisms of the present invention may use an NADH-dependent ADH to catalyze the conversion of isobutyraldehyde (+NADH) to produce isobutanol. In yet another embodiment, the recombinant microorganisms of the present invention may use both an NADH-dependent KAR1 to catalyze the conversion of acetolactate (+NADH) to produce 2,3-dihydroxyisovalerate, and an NADH-dependent ADH to catalyze the conversion of isobutyraldehyde (+NADH) to produce isobutanol.

In another embodiment, the yeast microorganism may be engineered to have increased ability to convert pyruvate to isobutanol. In one embodiment, the yeast microorganism may be engineered to have increased ability to convert pyruvate to isobutyraldehyde. In another embodiment, the yeast microorganism may be engineered to have increased ability to convert pyruvate to keto-isovalerate. In another embodiment, the yeast microorganism may be engineered to have increased ability to convert pyruvate to 2,3-dihydroxyisovalerate. In another embodiment, the yeast microorganism may be engineered to have increased ability to convert pyruvate to acetolactate.

Furthermore, any of the genes encoding the foregoing enzymes (or any others mentioned herein (or any of the regulatory elements that control or modulate expression thereof)) may be optimized by genetic/protein engineering techniques, such as directed evolution or rational mutagenesis, which are known to those of ordinary skill in the art. Such action allows those of ordinary skill in the art to optimize the enzymes for expression and activity in yeast.

In addition, genes encoding these enzymes can be identified from other fungal and bacterial species and can be expressed for the modulation of this pathway. A variety of organisms could serve as sources for these enzymes, including, but not limited to, *Saccharomyces* spp., including *S. cerevisiae* and *S. uvarum*, *Kluyveromyces* spp., including *K. thermotolerans*, *K. lactis*, and *K. marxianus*, *Pichia* spp., *Hansenula* spp., including *H. polymorpha*, *Candida* spp., *Trichosporon* spp., *Yamadazyma* spp., including *Y.* spp. *stipitis*, *Torulaspora pretoriensis*, *Schizosaccharomyces* spp., including *S. pombe*, *Cryptococcus* spp., *Aspergillus* spp., *Neurospora* spp., or *Ustilago* spp. Sources of genes from anaerobic fungi include, but not limited to, *Piromyces* spp., *Orpinomyces* spp., or *Neocallimastix* spp. Sources of prokaryotic enzymes that are useful include, but not limited to, *Escherichia coli*, *Zymomonas mobilis*, *Staphylococcus aureus*, *Bacillus* spp., *Clostridium* spp., *Corynebacterium* spp., *Pseudomonas* spp., *Lactococcus* spp., *Enterobacter* spp., and *Salmonella* spp.

Methods in General
Identification of an Aft Protein in a Microorganism

Any method can be used to identify genes that encode for proteins with Aft activity. Aft1 and Aft2 enhance cellular iron availability. Generally, genes that are homologous or similar to a known AFT gene, e.g. *S. cerevisiae* AFT1 (encoding for SEQ ID NO: 2) or *S. cerevisiae* AFT2 (encoding for SEQ ID NO: 4) can be identified by functional, structural, and/or genetic analysis. In most cases, homologous or similar AFT genes and/or homologous or similar Aft proteins will have functional, structural, or genetic similarities. Techniques known to those skilled in the art may be suitable to identify homologous genes and homologous enzymes. Generally, analogous genes and/or analogous enzymes can be identified by functional analysis and will have functional similarities. Techniques known to those skilled in the art may be suitable to identify analogous genes and analogous enzymes. For example, to identify homologous or analogous genes, proteins, or enzymes, techniques may include, but not limited to, cloning a AFT gene by PCR using primers based on a published sequence of a gene/enzyme or by degenerate PCR using degenerate primers designed to amplify a conserved region among AFT genes. Further, one skilled in the art can use techniques to identify homologous or analogous genes, proteins, or enzymes with functional homology or similarity. For instance, the computer program BLAST may be used for such a purpose. To identify homologous or similar genes and/or homologous or similar proteins, analogous genes and/or analogous proteins, techniques also include comparison of data concerning a candidate gene or enzyme with databases such as BRENDA, KEGG, or MetaCYC. The candidate gene or enzyme may be identified within the above mentioned databases in accordance with the teachings herein.

Identification of PDC and GPD in a Yeast Microorganism

Any method can be used to identify genes that encode for enzymes with pyruvate decarboxylase (PDC) activity or glycerol-3-phosphate dehydrogenase (GPD) activity. Suitable methods for the identification of PDC and GPD are described in co-pending applications U.S. Ser. No. 12/343,375 (published as US 2009/0226991), U.S. Ser. No. 12/696,645, and U.S. Ser. No. 12/820,505, which claim priority to U.S. Provisional Application 61/016,483, all of which are herein incorporated by reference in their entireties for all purposes.

Genetic Insertions and Deletions

Any method can be used to introduce a nucleic acid molecule into yeast and many such methods are well known. For example, transformation and electroporation are common methods for introducing nucleic acid into yeast cells. See, e.g., Gietz et al., 1992, *Nuc Acids Res.* 27: 69-74; Ito et al., 1983, *J. Bacteriol.* 153: 163-8; and Becker et al., 1991, *Methods in Enzymology* 194: 182-7.

In an embodiment, the integration of a gene of interest into a DNA fragment or target gene of a yeast microorganism occurs according to the principle of homologous recombination. According to this embodiment, an integration cassette containing a module comprising at least one yeast marker gene and/or the gene to be integrated (internal module) is flanked on either side by DNA fragments homologous to those of the ends of the targeted integration site (recombinogenic sequences). After transforming the yeast with the cassette by appropriate methods, a homologous recombination between the recombinogenic sequences may result in the internal module replacing the chromosomal region in between the two sites of the genome corresponding to the recombinogenic sequences of the integration cassette. (Orr-Weaver et al., 1981, *PNAS USA* 78: 6354-58).

In an embodiment, the integration cassette for integration of a gene of interest into a yeast microorganism includes the heterologous gene under the control of an appropriate promoter and terminator together with the selectable marker flanked by recombinogenic sequences for integration of a heterologous gene into the yeast chromosome. In an embodiment, the heterologous gene includes an appropriate native gene desired to increase the copy number of a native gene(s). The selectable marker gene can be any marker gene used in yeast, including but not limited to, HIS3, TRP1, LEU2, URA3, bar, ble, hph, and kan. The recombinogenic sequences can be chosen at will, depending on the desired integration site suitable for the desired application.

In another embodiment, integration of a gene into the chromosome of the yeast microorganism may occur via random integration (Kooistra et al., 2004, *Yeast* 21: 781-792).

Additionally, in an embodiment, certain introduced marker genes are removed from the genome using techniques well known to those skilled in the art. For example, URA3 marker loss can be obtained by plating URA3 containing cells in FOA (5-fluoro-orotic acid) containing medium and selecting for FOA resistant colonies (Boeke et al., 1984, *Mol. Gen. Genet.* 197: 345-47).

The exogenous nucleic acid molecule contained within a yeast cell of the disclosure can be maintained within that cell in any form. For example, exogenous nucleic acid molecules can be integrated into the genome of the cell or maintained in an episomal state that can stably be passed on ("inherited") to daughter cells. Such extra-chromosomal genetic elements (such as plasmids, mitochondrial genome, etc.) can additionally contain selection markers that ensure the presence of such genetic elements in daughter cells. Moreover, the yeast cells can be stably or transiently transformed. In addition, the yeast cells described herein can contain a single copy, or multiple copies of a particular exogenous nucleic acid molecule as described above.

Reduction of Enzymatic Activity

Yeast microorganisms within the scope of the invention may have reduced enzymatic activity such as reduced glycerol-3-phosphate dehydrogenase activity. The term "reduced" as used herein with respect to a particular enzymatic activity refers to a lower level of enzymatic activity than that measured in a comparable yeast cell of the same species. The term reduced also refers to the elimination of enzymatic activity than that measured in a comparable yeast cell of the same species. Thus, yeast cells lacking glycerol-3-phosphate dehydrogenase activity are considered to have reduced glycerol-3-phosphate dehydrogenase activity since most, if not all, comparable yeast strains have at least some glycerol-3-phosphate dehydrogenase activity. Such reduced enzymatic activities can be the result of lower enzyme concentration, lower specific activity of an enzyme, or a combination thereof. Many different methods can be used to make yeast having reduced enzymatic activity. For example, a yeast cell can be engineered to have a disrupted enzyme-encoding locus using common mutagenesis or knock-out technology. In addition, certain point-mutation(s) can be introduced which results in an enzyme with reduced activity.

Alternatively, antisense technology can be used to reduce enzymatic activity. For example, yeast can be engineered to contain a cDNA that encodes an antisense molecule that prevents an enzyme from being made. The term "antisense molecule" as used herein encompasses any nucleic acid molecule that contains sequences that correspond to the coding strand of an endogenous polypeptide. An antisense molecule also can have flanking sequences (e.g., regulatory sequences). Thus antisense molecules can be ribozymes or antisense oligonucleotides. A ribozyme can have any general structure including, without limitation, hairpin, hammerhead, or axhead structures, provided the molecule cleaves RNA.

Yeast having a reduced enzymatic activity can be identified using many methods. For example, yeast having reduced glycerol-3-phosphate dehydrogenase activity can be easily identified using common methods, which may include, for example, measuring glycerol formation via liquid chromatography.

Overexpression of Heterologous Genes

Methods for overexpressing a polypeptide from a native or heterologous nucleic acid molecule are well known. Such methods include, without limitation, constructing a nucleic acid sequence such that a regulatory element promotes the expression of a nucleic acid sequence that encodes the desired polypeptide. Typically, regulatory elements are DNA sequences that regulate the expression of other DNA sequences at the level of transcription. Thus, regulatory elements include, without limitation, promoters, enhancers, and the like. For example, the exogenous genes can be under the control of an inducible promoter or a constitutive promoter. Moreover, methods for expressing a polypeptide from an exogenous nucleic acid molecule in yeast are well known. For example, nucleic acid constructs that are used for the expression of exogenous polypeptides within *Kluyveromyces* and *Saccharomyces* are well known (see, e.g., U.S. Pat. Nos. 4,859,596 and 4,943,529, for *Kluyveromyces* and, e.g., Gellissen et al., Gene 190(1):87-97 (1997) for *Saccharomyces*). Yeast plasmids have a selectable marker and an origin of replication. In addition certain plasmids may also contain a centromeric sequence. These centromeric plasmids are generally a single or low copy plasmid. Plasmids without a centromeric sequence and utilizing either a 2 micron (*S. cerevisiae*) or 1.6 micron (*K. lactis*) replication origin are high copy plasmids. The selectable marker can be either prototrophic, such as HIS3, TRP1, LEU2, URA3 or ADE2, or antibiotic resistance, such as, bar, ble, hph; or kan.

In another embodiment, heterologous control elements can be used to activate or repress expression of endogenous genes. Additionally, when expression is to be repressed or eliminated, the gene for the relevant enzyme, protein or RNA can be eliminated by known deletion techniques.

As described herein, any yeast within the scope of the disclosure can be identified by selection techniques specific to the particular enzyme being expressed, over-expressed or repressed. Methods of identifying the strains with the desired phenotype are well known to those skilled in the art. Such methods include, without limitation, PCR, RT-PCR, and nucleic acid hybridization techniques such as Northern and Southern analysis, altered growth capabilities on a particular substrate or in the presence of a particular substrate, a chemical compound, a selection agent and the like. In some cases, immunohistochemistry and biochemical techniques can be used to determine if a cell contains a particular nucleic acid by detecting the expression of the encoded polypeptide. For example, an antibody having specificity for an encoded enzyme can be used to determine whether or not a particular yeast cell contains that encoded enzyme. Further, biochemical techniques can be used to determine if a cell contains a particular nucleic acid molecule encoding an enzymatic polypeptide by detecting a product produced as a result of the expression of the enzymatic polypeptide. For example, transforming a cell with a vector encoding acetolactate synthase and detecting increased acetolactate concentrations compared to a cell without the vector indicates that the vector is both present and that the gene product is active. Methods for detecting specific enzymatic activities or the presence of particular products are well known to those skilled in the art. For example, the presence of acetolactate can be determined as described by Hugenholtz and Starrenburg, 1992, *Appl. Micro. Biot.* 38:17-22.

Methods for the Overexpression of AFT Genes

Overexpression of the AFT1 and AFT2 genes may be accomplished by any number of methods. In one embodiment, overexpression of the AFT1 and AFT2 genes may be accomplished with the use of plasmid vectors that function in yeast. In exemplary embodiments, the expression of AFT1, AFT2, and/or homologous genes may be increased by overexpressing the genes on a CEN plasmid or alternative plasmids with a similar copy number. In one embodiment, AFT1 or a homolog thereof is overexpressed on a CEN plasmid or alternative plasmids with a similar copy number. In another embodiment, AFT2 or a homolog thereof is overexpressed on a CEN plasmid or alternative plasmids with a similar copy number. In yet another embodiment, AFT1 and AFT2 or homologs thereof are overexpressed on a CEN plasmid or alternative plasmids with a similar copy number.

In further embodiments, expression of genes from single or multiple copy integrations into the chromosome of the cell may be useful. Use of a number of promoters, such as TDH3, TEF1, CCW12, PGK1, and ENO2, may be utilized. As would be understood in the art, the expression level may be fine-tuned by using a promoter that achieves the optimal expression (e.g. optimal overexpression) level in a given yeast. Different levels of expression of the genes may be achieved by using promoters with different levels of activity, either in single or multiple copy integrations or on plasmids. An example of such a group of promoters is a series of truncated PDC1 promoters designed to provide different strength promoters. Alternatively promoters that are active under desired conditions, such as growth on glucose, may be used. For example a promoter from one of the glycolytic genes, the PDC1 promoter, and a promoter from one of the ADH genes in *S. cerevisiae* may all be useful. Also, embodiments are exemplified using the yeast *S. cerevisiae*. However, other yeasts, such as those from the genera listed herein may also be used.

As described herein, overexpression of the Aft1 protein or a homolog thereof may be obtained by expressing a constitutively active Aft1 or a homolog thereof. In one embodiment, the constitutively active Aft1 or a homolog thereof comprises a mutation at a position corresponding to the cysteine 291 residue of the native *S. cerevisiae* Aft1 (SEQ ID NO: 2). In a specific embodiment, the cysteine 291 residue is replaced with a phenylalanine residue.

As described herein, overexpression of the Aft2 protein or a homolog thereof may be obtained by expressing a constitutively active Aft2 or a homolog thereof. In one embodiment, the constitutively active Aft2 or a homolog thereof comprises a mutation at a position corresponding to the cysteine 187 residue of the native *S. cerevisiae* Aft2 (SEQ ID NO: 2). In a specific embodiment, the cysteine 187 residue is replaced with a phenylalanine residue.

Increase of Enzymatic Activity

Yeast microorganisms of the invention may be further engineered to have increased activity of enzymes. The term "increased" as used herein with respect to a particular enzymatic activity refers to a higher level of enzymatic activity than that measured in a comparable yeast cell of the same species. For example, overexpression of a specific enzyme can lead to an increased level of activity in the cells for that enzyme. Increased activities for enzymes involved in glycolysis or the isobutanol pathway would result in increased productivity and yield of isobutanol.

Methods to increase enzymatic activity are known to those skilled in the art. Such techniques may include increasing the expression of the enzyme by increased copy number and/or use of a strong promoter, introduction of mutations to relieve negative regulation of the enzyme, introduction of specific mutations to increase specific activity and/or decrease the Km for the substrate, or by directed evolution. See, e.g., Methods in Molecular Biology (vol. 231), ed. Arnold and Georgiou, Humana Press (2003).

Methods of Using Recombinant Microorganisms for High-Yield Fermentations

For a biocatalyst to produce a beneficial metabolite most economically, it is desirable to produce said metabolite at a high yield. Preferably, the only product produced is the desired metabolite, as extra products (i.e. by-products) lead to a reduction in the yield of the desired metabolite and an increase in capital and operating costs, particularly if the extra products have little or no value. These extra products also require additional capital and operating costs to separate these products from the desired metabolite.

In one aspect, the present invention provides a method of producing a beneficial metabolite derived from a DHAD-requiring biosynthetic pathway. In one embodiment, the method includes cultivating a recombinant microorganism comprising a DHAD-requiring biosynthetic pathway in a culture medium containing a feedstock providing the carbon source until a recoverable quantity of the beneficial metabolite is produced and optionally, recovering the metabolite. In an exemplary embodiment, said recombinant microorganism has been engineered to overexpress a polynucleotide encoding Aft1 (SEQ ID NO: 2) and/or Aft2 (SEQ ID NO: 4) or a homolog thereof. The beneficial metabolite may be derived from any DHAD-requiring biosynthetic pathway, including, but not limited to, biosynthetic pathways for the production of isobutanol, 3-methyl-1-butanol, 2-methyl-1-butanol, valine, isoleucine, leucine, and pantothenic acid. In a specific embodiment, the beneficial metabolite is isobutanol.

In a method to produce a beneficial metabolite from a carbon source, the yeast microorganism is cultured in an appropriate culture medium containing a carbon source. In certain embodiments, the method further includes isolating the beneficial metabolite from the culture medium. For example, isobutanol may be isolated from the culture medium by any method known to those skilled in the art, such as distillation, pervaporation, or liquid-liquid extraction In one embodiment, the recombinant microorganism may produce the beneficial metabolite from a carbon source at a yield of at least 5 percent theoretical. In another embodiment, the microorganism may produce the beneficial metabolite from a carbon source at a yield of at least about 10 percent, at least about 15 percent, about least about 20 percent, at least about 25 percent, at least about 30 percent, at least about 35 percent, at least about 40 percent, at least about 45 percent, at least about 50 percent, at least about 55 percent, at least about 60 percent, at least about 65 percent, at least about 70 percent, at least about 75 percent, at least about 80 percent, at least about 85 percent, at least about 90 percent, at least about 95 percent, or at least about 97.5% theoretical. In a specific embodiment, the beneficial metabolite is isobutanol.

This invention is further illustrated by the following examples that should not be construed as limiting. The contents of all references, patents, and published patent applications cited throughout this application, as well as the Figures and the Sequence Listing, are incorporated herein by reference for all purposes.

EXAMPLES

General Materials and Methods for Examples

Media: Media used were standard yeast medium (for example Sambrook, J., Russel, D. W. Molecular Cloning, A Laboratory Manual. 3rd ed. 2001, Cold Spring Harbor, N.Y.: Cold Spring Harbor Laboratory Press and Guthrie, C. and Fink, G. R. eds. Methods in Enzymology Part B: Guide to Yeast Genetics and Molecular and Cell Biology 350:3-623 (2002)). YP medium contains 1% (w/v) yeast extract, 2% (w/v) peptone. YPD is YP containing 2% (w/v) glucose.

*S. cerevisiae* Transformations: The yeast strain of interest was grown on YPD medium. The strain was re-suspended in 100 mM lithium acetate. Once the cells were re-suspended, a mixture of DNA (final volume of 15 μL with sterile water), 72 μL 50% w/v PEG, 10 μL 1 M lithium acetate, and 3 μL of denatured salmon sperm DNA (10 mg/mL) was prepared for each transformation. In a 1.5 mL tube, 15 μL of the cell suspension was added to the DNA mixture (100 μL), and the transformation suspension was vortexed for 5 short pulses. The transformation was incubated for 30 min at 30° C., followed by incubation for 22 min at 42° C. The cells were collected by centrifugation (18,000 rcf, 10 sec, 25° C.). The cells were resuspended in 1 mL YPD and after an overnight recovery shaking at 30° C. and 250 rpm, the cells were spread over YPD+0.2 g/L G418+0.1 g/L hygromycin selective plates. Transformants were then single colony purified onto selective plates containing appropriate antibiotics.

Preparation of Yeast Lysate: Cells were Thawed on Ice and Resuspended in lysis buffer (50 mM Tris pH 8.0, 5 mM MgSO$_4$) such that the result was a 20% cell suspension by mass. 1000 μL of glass beads (0.5 mm diameter) were added to a 1.5 mL microcentrifuge tube and 875 μL of cell suspension was added. Yeast cells were lysed using a Retsch MM301 mixer mill (Retsch Inc. Newtown, Pa.), mixing 6×1 min each at full speed with 1 min incubations on ice between each bead-beating step. The tubes were centrifuged for 10 min at 23,500 rcf at 4° C. and the supernatant was removed for use. The lysates were held on ice until assayed.

DHAD Assay: Each sample was diluted in DHAD assay buffer (50 mM Tris pH 8, 5 mM $MgSO_4$) to a 1:10 and a 1:40 to 1:100 dilution. Three samples of each lysate were assayed, along with no lysate controls. 10 µL of each sample (or DHAD assay buffer) was added to 0.2 mL PCR tubes. Using a multi-channel pipette, 90 µL of the substrate was added to each tube (substrate mix was prepared by adding 4 mL DHAD assay buffer to 0.5 mL 100 mM DHIV). Samples were put in a thermocycler (Eppendorf Mastercycler) at 35° C. for 30 min followed by a 5 min incubation at 95° C. Samples were cooled to 4° C. on the thermocycler, then centrifuged at 3000 rcf for 5 min. Finally, 75 µL of supernatant was transferred to new PCR tubes and submitted to analytics for analysis by Liquid Chromatography, method 2. DHAD activity units were calculated as µmol KIV produced/min/mg total cell lysate protein in the assay.

Protein Concentration Determination: Yeast lysate protein concentration was determined using the BioRad Bradford Protein Assay Reagent Kit (Cat# 500-0006, BioRad Laboratories, Hercules, Calif.) and using BSA for the standard curve. Briefly, 10 µL standard or lysate were added into a microcentrifuge tube. The samples were diluted to fit in the linear range of the standard curve (1:40). 500 µL of 1:4 diluted and filtered Bio-Rad protein assay dye was added to the blank and samples and then vortexed. Samples were incubated at room temperature for 6 min, transferred into cuvettes and the $OD_{595}$ was determined in a spectrophotometer. The linear regression of the standards was then used to calculate the protein concentration in each sample.

Gas Chromatography: Analysis of volatile organic compounds including isobutanol, was performed on a HP 5890/6890/7890 gas chromatograph fitted with an HP 7673 Autosampler, a ZB-FFAP column (Phenomenex; 30 m length, 0.32 mm ID, 0.25 µM film thickness) or equivalent connected to a flame ionization detector (FID). The temperature program was as follows: 200° C. for the injector, 300° C. for the detector, 100° C. oven for 1 min, 70° C./min gradient to 230° C., and then hold for 2.5 min. Analysis was performed using authentic standards (>99%, obtained from Sigma-Aldrich) and a 5-point calibration curve with 1-pentanol as the internal standard.

Liquid Chromatography, Method 1: Analysis of organic acid metabolites, specifically pyruvate, acetate, 2,3-dihydroxy-isovalerate, and 2,3-butanediol, was performed on an HP-1200 High Performance Liquid Chromatography system equipped with two Rezex RFQ 150×4.6 mm columns in series. Organic acid metabolites were detected using an HP-1100 UV detector (210 nm) and refractive index. The column temperature was 60° C. This method was isocratic with 0.0180 N $H_2SO_4$ in Milli-Q water as mobile phase. Flow was set to 1.1 mL/min. Injection volume was 20 µL and run time was 16 min. Analysis was performed using authentic standards (>99%, obtained from Sigma-Aldrich, with the exception of DHIV (2,3-dihydroxy-3-methyl-butanoate, CAS 1756-18-9), which was custom synthesized at Caltech (Cioffi, E. et al. Anal Biochem 104 pp. 485 (1980)), and a 5-point calibration curve.

Liquid Chromatography, Method 2: Analysis of 2-ketoisovalerate (KIV), the product indicating DHAD activity, was measured using liquid chromatography. DNPH reagent (12 mM 2,4-Dinitrophenyl Hydrazine, 20 mM Citric Acid pH 3.0, 80% Acetonitrile, 20% MilliQ $H_2O$) was added to each sample in a 1:1 ratio. Samples were incubated for 30 min at 70° C. in a thermo-cycler (Eppendorf, Mastercycler). Analysis of KIV was performed on an HP-1200 High Performance Liquid Chromatography system equipped with an Eclipse XDB C-18 reverse phase column (Agilent) and a C-18 reverse phase column guard (Phenomenex). KIV was detected using an HP-1100 UV detector (360 nm). The column temperature was 50° C. This method was isocratic with 70% acetonitrile 2.5% phosphoric acid (4%), 27.5% water as mobile phase. Flow was set to 3 mL/min. Injection size was 10 µL and run time was 2 min.

Example 1

Overexpression of AFT1 Increases DHAD Activity and Isobutanol Productivity, Titer, and Yield in Fermentation Vessels The purpose of this example is to demonstrate that overexpression of AFT1 increases DHAD activity, isobutanol titer, productivity, and yield.

Media: Medium used for the fermentation was YP+80 g/L glucose+0.2 g/L G418+0.1 g/L hygromycin+100 µM $CuSO_4.5H_2O$+1% v/v ethanol. The medium was filter sterilized using a 1 L bottle top Corning PES 0.22 µm filter (431174). Medium was pH adjusted to 6.0 in the fermenter vessels using 6N KOH.

Vessel Preparation and Operating Conditions: Batch fermentations were conducted using six 2 L top drive motor DasGip vessels with a working volume of 0.9 L per vessel. Vessels were sterilized, along with the appropriate dissolved oxygen probes and pH probes, for 60 min at 121° C. pH probes were calibrated prior to sterilization, however, dissolved oxygen probes were calibrated post sterilization in order to allow for polarization.

Process Control Parameters: Initial volume, 900 mL. Temperature, 30° C. pH 6.0, pH was controlled using 6N KOH and 2N $H_2SO_4$ (Table 4).

TABLE 4

| Process control parameters. | | |
|---|---|---|
| Growth phase | Oxygen transfer rate | 10 mM/h |
| | Air overlay | 5.0 slph |
| | Agitation | 700 rpm |
| | Dissolved oxygen | Not controlled |
| Fermentation phase | Oxygen transfer rate | 0.5 mM/h to 1.8 mM/h* |
| | Air overlay | 5.0 slph |
| | Agitation | 300 rpm/400 rpm* |
| | Dissolved oxygen | Not controlled |

*Oxygen transfer rate increased from 0.5 mM/h to 1.8 mM/h by increase in agitation from 300 rpm to 400 rpm 56 h post inoculation.

Fermentation: The fermentation was run for 119 h. Vessels were sampled 3 times daily. Sterile 5 mL syringes were used to collect 3 mL of fermenter culture via a sterile sample port. The sample was placed in a 2 mL microfuge tube and a portion was used to measure cell density ($OD_{600}$) on a Genesys 10 spectrophotometer (Thermo Scientific). The remaining sample was filtered through a 0.22 µm pore-size Corning filter. The supernatant from each vessel was refrigerated in a 96-well, deep well plate, and stored at 4° C. prior to gas and liquid chromatography analysis (see General Methods).

Off-gas Measurements: On-line continuous measurement of each fermenter vessel off-gas by mass spectrometry analysis was performed for oxygen, isobutanol, ethanol, carbon dioxide, and nitrogen throughout the experiment. Fermentor off-gas was analyzed by Prima dB mass spectrometer (Thermo, Waltham, Mass.) for nitrogen, oxygen, argon, carbon dioxide, isobutanol, ethanol, and isobutyraldehyde. A reference stream of similar composition to the inlet fermentor air was also analyzed. The mass spectrometer cycles through the reference air and fermentor off-gas streams (one by one)

and measures percent concentration of these gases after an 8.3 min settling time to ensure representative samples. Equation 1 is a derived value expression input into the mass spectrometer software to determine OTR using percent oxygen and percent nitrogen from the reference air (% $O_{2in}$ and % $N_{2in}$) and fermentor off-gas (% $O_{2out}$ and % $N_{2out}$). Nitrogen is not involved in cellular respiration, and therefore, can be used to compensate for outlet oxygen dilution caused by the formation of $CO_2$. The inlet flow is calculated from Equation 2 based on the ideal gas law and is standardized to 1.0 sLph flow rate and 1.0 L fermentor working volume to yield a derived value OTR in mmol/Uh from the mass spectrometer. This derived value OTR is then multiplied by actual inlet flow rate (sLph) and divided by actual working volume (L) in fermentation spreadsheets to obtain an OTR for specific operating conditions.

$$OTR = \left[\% \ O2_{in} - \left(\% \ O2_{out} * \frac{\% \ N2_{in}}{\% \ N2_{out}}\right)\right] * Flow_{in}. \quad \text{Equation 1}$$

$$Flow_{in} = \frac{1 \ L}{h} * \left[\frac{0.83 \ atm}{0.08206 \frac{L \ atm}{mol \ K} * 294 \ K * 1 \ L}\right] * \frac{1000 \ mmol}{mol}. \quad \text{Equation 2}$$

See the General Methods for a description of how the yeast transformations were performed, as well as a description of how the yeast lysate was prepared. The DHAD assay and protein concentration assay are also described in the general methods section. Strains, plasmids, and the gene/protein sequences used in Example 1 are described in Tables 5, 6, and 7, respectively.

TABLE 5

Genotype of strain disclosed in Example 1.

| GEVO Number | Genotype |
| --- | --- |
| GEVO2843 | S. cerevisiae CEN.PK2, MATa ura3 leu2 his3 trp1 pdc1Δ::[$P_{CUP1}$:Bs_alsS1_coSc:$T_{CYC1}$: $P_{PGK1}$: Ll_kivD2: $P_{ENO2}$: Sp_HIS5] pdc5Δ::[LEU2-bla-$P_{TEF1}$: ILV3ΔN: $P_{TDH3}$: Ec_ilvC_coSc$^{Q110V}$] pdc6Δ::[URA3: bla; $P_{TEF1}$: Ll_kivD2: $P_{TDH3}$: Dm_ADH] {evolved for C2 supplement-independence, glucose tolerance and faster growth} |

TABLE 6

Plasmids disclosed in Example 1.

| Plasmid Name | Relevant Genes/Usage | Genotype |
| --- | --- | --- |
| pGV2227 | Plasmid pGV2227 is a 2 micron plasmid expressing KARI, DHAD, KIVD, and ADH | $P_{TDH3}$: Ec_ilvC_coSc$^{Q110V}$ $P_{TEF1}$: Ll_ilvD_coSc $P_{PGK1}$-Ll_kivD2_coEc $P_{ENO2}$_Ll_adhA 2μ ori, bla, G418R |
| pGV2196 | Empty CEN plasmid | $P_{TDH3}$: empty $P_{TEF1}$: empty $P_{PGK1}$: empty CEN ori, bla, HygroR |
| pGV2472 | CEN plasmid expressing AFT1 | $P_{TDH3}$: Sc_AFT1 $P_{TEF1}$: empty $P_{PGK1}$: empty CEN ori, bla, HygroR |

TABLE 7

Nucleotide and amino acid sequences of genes and proteins disclosed in Examples.

| Protein | Source | Gene (SEQ ID NO) | Protein (SEQ ID NO) |
| --- | --- | --- | --- |
| AFT | S. cerevisiae | Sc_AFT1 (SEQ ID NO: 1) | Sc_Aft1 (SEQ ID NO: 2) |
| | S. cerevisiae | Sc_AFT2 (SEQ ID NO: 3) | Sc_Aft2 (SEQ ID NO: 4) |
| | K. lactis | Kl_AFT (SEQ ID NO: 13) | Kl_Aft (SEQ ID NO: 14) |
| | K. marxianus | Km_AFT (SEQ ID NO: 29) | Km_Aft (SEQ ID NO: 30) |
| | I. orientalis | Io_AFT1-2 (SEQ ID NO: 33) | Io_Aft1-2 (SEQ ID NO: 34) |
| ALS | B. subtilis | Bs_alsS1_coSc (SEQ ID NO: 40) | Bs_AlsS1 (SEQ ID NO: 41) |
| KARI | E. coli | Ec_ilvC_coSc$^{Q110V}$ (SEQ ID NO: 42) | Ec_IlvC$^{Q110V}$ (SEQ ID NO: 43) |
| | E. coli | Ec_ilvC_coSc$^{P2D1A7}$ (SEQ ID NO: 44) | Ec_IlvC$^{P2D1A7}$ (SEQ ID NO: 45) |
| KIVD | L. lactis | Ll_kivd2_coEc (SEQ ID NO: 46) | Ll_Kivd2 (SEQ ID NO: 47) |
| DHAD | L. lactis | Ll_ilvD_coSc (SEQ ID NO: 48) | Ll_IlvD (SEQ ID NO: 49) |
| | S. cerevisiae | Sc_ILV3ΔN20 (SEQ ID NO: 50) | Sc_Ilv3ΔN20 (SEQ ID NO: 51) |
| | S. mutans | Sm_ilvD_coSc (SEQ ID NO: 52) | Sm_IlvD (SEQ ID NO: 53) |
| | N. crassa | Nc_ILVD2_coSc (SEQ ID NO: 54) | Nc_IlvD2 (SEQ ID NO: 55) |
| ADH | D. melanogaster | Dm_ADH (SEQ ID NO: 56) | Dm_Adh (SEQ ID NO: 57) |
| | L. lactis | Ll_adhA (SEQ ID NO: 58) | Ll_AdhA (SEQ ID NO: 59) |
| | L. lactis | Ll_adhA$^{RE1}$ (SEQ ID NO: 60) | Ll_AdhA$^{RE1}$ (SEQ ID NO: 61) |
| TFC1 | S. cerevisiae | TFC1 (SEQ ID NO: 202) | Tfc1 (SEQ ID NO: 203) |

GEVO2843 was co-transformed with two plasmids (Table 8). GEVO3342 contains plasmids pGV2227 and pGV2196; GEVO3343 contains plasmids pGV2227 and pGV2472.

TABLE 8

Indicates the strains containing plasmids transformed together into strain GEVO2843.

| GEVO | Plasmid 1 | Plasmid 2 |
| --- | --- | --- |
| 3342 | pGV2227 (DHAD) | pGV2196 (no AFT1) |
| 3343 | pGV2227 (DHAD) | pGV2472 (AFT1) |

DHAD Assay Results: The in vitro DHAD enzymatic activity of lysates from the microaerobic fermentation of GEVO3342 and GEVO3343 were carried out as described above. Overexpression of AFT1 from a CEN plasmid resulted in a three-fold increase in specific DHAD activity (U/mg total cell lysate protein). Data is presented as specific DHAD activity (U/mg total cell lysate protein) averages from technical triplicates with standard deviations. DHAD activity for GEVO3342 (control) was 0.066±0.005 U/mg and DHAD activity for GEVO3343 (AFT1 over-expressed) was 0.215±0.008 U/mg at the end of the fermentation (119 h).

Isobutanol Results: Isobutanol titers, rates and yields were calculated based on the experiment run in batch fermentors. Table 9 shows the increase in isobutanol titer, rate and yield in the strain overexpressing the AFT1 gene. The overexpression of AFT1 from a CEN plasmid (GEVO3343) resulted in an increase in isobutanol titer, an increase in isobutanol yield, and an increase in isobutanol rate.

TABLE 9

Isobutanol titer, rate and yield for replicate fermentation experiments.

|  | GEVO3342 | GEVO3342 control plasmid | GEVO3343 Aft1 gene on a CEN plasmid | GEVO3343 |
|---|---|---|---|---|
| Titer (g/L) | 3.66 | 3.96 | 5.69 | 5.80 |
| Rate (g/L/h) | 0.03 | 0.03 | 0.05 | 0.05 |
| Yield (% theor.) | 19 | 20 | 34 | 34 |

Change in metabolic by-products: The strain transformed with the AFT1 gene expressed on the CEN plasmid (GEVO3343) produced less pyruvate, acetate, DHIV (dihydroxyisovalerate)/DH2 MB (2,3-dihydroxy-2-methylbutanoic acid), and 2,3-butanediol than the strain with the control plasmid (GEVO3342) during the fermentation. There was a six fold decrease in pyruvate, one fold decrease in acetate, one and a half fold decrease in DHIV/DH2MB, and six fold decrease in 2,3-butanediol.

Example 2

Overexpression of AFT2 Increases DHAD Activity

The purpose of this example is to demonstrate that overexpression of AFT2 increases DHAD activity. Methods of strain construction and cloning techniques are described in Example 1. Strain GEVO2843 is described in Table 5.

TABLE 10

Plasmids disclosed in Example 2.

| Plasmid Name | Relevant Genes/Usage | Genotype |
|---|---|---|
| pGV2247 | Plasmid pGV2247 is a 2 micron plasmid expressing KARI, DHAD, KIVD, and ADH | $P_{TDH3}$:Ec_ilvC_coSc$^{P2D1A1}$ $P_{TEF1}$:Ll_ilvD_coSc $P_{PGK1}$-Ll_kivD2_coEc $P_{ENO2}$: Ll_adhA 2µ ori, bla, G418R |
| pGV2196 | Empty CEN plasmid | $P_{TDH3}$: empty $P_{TEF1}$: empty $P_{PGK1}$: empty CEN ori, bla, HygroR |
| pGV2627 | CEN plasmid expressing AFT2 | $P_{TDH3}$:empty $P_{TEF1}$: empty $P_{PGK1}$:Sc_AFT2 CEN ori, bla, HygroR |

Methods

Methods for yeast transformations and the preparation of yeast lysates are described in the general methods. The DHAD assay, the liquid chromatography, method 2, assay, and assays for measuring protein concentration are described in the general methods.

Results for DHAD Activity: Data is presented as specific DHAD activity (U/mg total cell lysate protein) averages from biological and technical triplicates with standard deviations. DHAD activity in GEVO2843 (Table 5) transformed with pGV2247+pGV2196 (no AFT2) was 0.358±0.009 U/mg, DHAD activity for pGV2247+pGV2627 (contains AFT2) was 0.677±0.072 U/mg. The overexpression of AFT2 increased the amount of DHAD activity in the strain.

Example 3

Overexpression of AFT1 Increases DHAD Activity for DHAD Enzymes from Multiple Organisms The purpose of this example is to demonstrate that overexpression of AFT1 increases DHAD activity for DHAD enzymes from multiple organisms.

Strains and plasmids used in Example 4 are described in Tables 11 and 12, respectively.

TABLE 11

Genotype of strains disclosed in Example 3.

| GEVO Number | Genotype | Plasmid |
|---|---|---|
| GEVO3626 | Saccharomyces cerevisiae MATa ura3 leu2 his3 trp1 gpd1::$T_{Kl\_URA3}$ gpd2::$T_{Kl\_URA3}$pdc1::$P_{PDC1}$:Ll_kivD2_coSc5:$P_{FBA1}$:LEU2:$T_{LEU2}$-$P_{ADH1}$:Bs_alsS1_coSc:$T_{CYC1}$:$P_{PGK1}$:Ll_kivD2_coEc:$P_{ENO2}$:Sp_HIS5 pdc5::$T_{Kl\_URA3\_short}$:$P_{FBA1}$:Kl_URA3:$T_{Kl\_URA3}$ pdc6::$P_{TEF}$:Ll_ilvD_coSc_$P_{TDH3}$:Ec_ilvC_coSc$^{P2D1-A1}$: $P_{ENO2}$:Ll_adhA:$P_{FBA1}$:Sc_TRP1 {evolved for C2 supplement-independence, glucose tolerance and faster growth} | None |
| GEVO3873 | Saccharomyces cerevisiae MATa ura3 leu2 his3 trp1 gpd1::$T_{Kl\_URA3}$, gpd2::$T_{Kl\_URA3}$ pdc1::$P_{PDC1}$:Ll_kivD2_coSc5:$P_{FBA1}$:LEU2:$T_{LEU2}$:$P_{ADH1}$:Bs_alsS1_coSc:$T_{CYC1}$:$P_{PGK1}$: Ll_kivD2_coEc:$P_{ENO2}$:Sp_HIS5 pdc5::$T_{Kl\_URA3\_short}$:$P_{FBA1}$:Kl_URA3:$T_{Kl\_URA3}$ pdc6::$P_{TEF}$:Ll_ilvD_coSc_$P_{TDH3}$:Ec_ilvC_coSc$^{P2D1-A1}$: $P_{ENO2}$:Ll_adhA:$P_{FBA1}$:Sc_TRP1 {evolved for C2 supplement-independence, glucose tolerance and faster growth} | pGV2603 |
| GEVO3874 | Saccharomyces cerevisiae MATa ura3 leu2 his3 trp1 gpd1::$T_{Kl\_URA3}$ gpd2::$T_{Kl\_URA3}$ pdc1::$P_{PDC1}$:Ll_kivD2_coSc5:$P_{FBA1}$:LEU2:$T_{LEU2}$:$P_{ADH1}$:Bs_alsS1_coSc:$T_{CYC1}$:$P_{PGK1}$: Ll_kivD2_coEc:$P_{ENO2}$:Sp_HIS5 pdc5::$T_{Kl\_URA3\_short}$:$P_{FBA1}$:Kl_URA3:$T_{Kl\_URA3}$ pdc6::$P_{TEF}$:Ll_ilvD_coSc_$P_{TDH3}$:Ec_ilvC_coSc$^{P2D1-A1}$: $P_{ENO2}$:Ll_adhA:$P_{FBA1}$:Sc_TRP1 {evolved for C2 supplement-independence, glucose tolerance and faster growth} | pGV2603 |
| GEVO3875 | Saccharomyces cerevisiae MATa ura3 leu2 his3 trp1 gpd1::$T_{Kl\_URA3}$ gpd2::$T_{Kl\_URA3}$ pdc1::$P_{PDC1}$:Ll_kivD2_coSc5:$P_{FBA1}$:LEU2:$T_{LEU2}$:$P_{ADH1}$:Bs_alsS1_coSc:$T_{CYC1}$:$P_{PGK1}$: Ll_kivD2_coEc:$P_{ENO2}$:Sp_HIS5 pdc5::$T_{Kl\_URA3\_short}$:$P_{FBA1}$:Kl_URA3:$T_{Kl\_URA3}$ pdc6::$P_{TEF}$:Ll_ilvD_coSc_$P_{TDH3}$:Ec_ilvC_coSc$^{P2D1-A1}$: | pGV2607 |

TABLE 11-continued

Genotype of strains disclosed in Example 3.

| GEVO Number | Genotype | Plasmid |
|---|---|---|
| | $P_{ENO2}$:Ll_adhA:$P_{FBA1}$:Sc_TRP1 {evolved for C2 supplement-independence, glucose tolerance and faster growth} | |
| GEVO3876 | Saccharomyces cerevisiae MATa ura3 leu2 his3 trp1 gpd1::$T_{Kl\_URA3}$ gpd2::$T_{Kl\_URA3}$ pdc1::$P_{PDC1}$:Ll_kivD2_coSc5:$P_{FBA1}$:LEU2:$T_{LEU2}$:$P_{ADH1}$:Bs_alsS1_coSc:$T_{CYC1}$:$P_{PGK1}$: Ll_kivD2_coEc:$P_{ENO2}$:Sp_HIS5 pdc5::$T_{Kl\_URA3\_short}$:$P_{FBA1}$:Kl_URA3:$T_{Kl\_URA3}$ pdc6::$P_{TEF}$:Ll_ilvD_coSc_$P_{TDH3}$:Ec_ilvC_coSc$^{P2D1-A1}$: $P_{ENO2}$:Ll_adhA:$P_{FBA1}$:Sc_TRP1 {evolved for C2 supplement-independence, glucose tolerance and faster growth} | pGV2608 |
| GEVO3877 | Saccharomyces cerevisiae MATa ura3 leu2 his3 trp1 gpd1::$T_{Kl\_URA3}$ gpd2::$T_{Kl\_URA3}$ pdc1::$P_{PDC1}$:Ll_kivD2_coSc5:$P_{FBA1}$:LEU2:$T_{LEU2}$:$P_{ADH1}$:Bs_alsS1_coSc:$T_{CYC1}$:$P_{PGK1}$: Ll_kivD2_coEc:$P_{ENO2}$:Sp_HIS5 pdc5::$T_{Kl\_URA3\_short}$:$P_{FBA1}$:Kl_URA3:$T_{Kl\_URA3}$ pdc6::$P_{TEF}$:Ll_ilvD_coSc_$P_{TDH3}$:Ec_ilvC_coSc$^{P2D1-A1}$: $P_{ENO2}$:Ll_adhA:$P_{FBA1}$:Sc_TRP1 {evolved for C2 supplement-independence, glucose tolerance and faster growth} | pGV2608 |
| GEVO3878 | Saccharomyces cerevisiae MATa ura3 leu2 his3 trp1 gpd1::$T_{Kl\_URA3}$ gpd2::$T_{Kl\_URA3}$ pdc1::$P_{PDC1}$:Ll_kivD2_coSc5:$P_{FBA1}$:LEU2:$T_{LEU2}$:$P_{ADH1}$:Bs_alsS1_coSc:$T_{CYC1}$:$P_{PGK1}$: Ll_kivD2_coEc:$P_{ENO2}$:Sp_HIS5 pdc5::$T_{Kl\_URA3\_short}$:$P_{FBA1}$:Kl_URA3:$T_{Kl\_URA3}$ pdc6::$P_{TEF}$:Ll_ilvD_coSc_$P_{TDH3}$:Ec_ilvC_coSc$^{P2D1-A1}$: $P_{ENO2}$:Ll_adhA:$P_{FBA1}$:Sc_TRP1 {evolved for C2 supplement-independence, glucose tolerance and faster growth} | pGV2608 |
| GEVO3879 | Saccharomyces cerevisiae MATa ura3 leu2 his3 trp1 gpd1::$T_{Kl\_URA3}$ gpd2::$T_{Kl\_URA3}$ pdc1::$P_{PDC1}$:Ll_kivD2_coSc5:$P_{FBA1}$:LEU2:$T_{LEU2}$:$P_{ADH1}$:Bs_alsS1_coSc:$T_{CYC1}$:$P_{PGK1}$: Ll_kivD2_coEc:$P_{ENO2}$:Sp_HIS5 pdc5::$T_{Kl\_URA3\_short}$:$P_{FBA1}$:Kl_URA3:$T_{Kl\_URA3}$ pdc6::$P_{TEF}$:Ll_ilvD_coSc_$P_{TDH3}$:Ec_ilvC_coSc$^{P2D1-A1}$: $P_{ENO2}$:Ll_adhA:$P_{FBA1}$:Sc_TRP1 {evolved for C2 supplement-independence, glucose tolerance and faster growth} | pGV2603 + pGV2472 |
| GEVO3880 | Saccharomyces cerevisiae MATa ura3 leu2 his3 trp1 gpd1::$T_{Kl\_URA3}$ gpd2::$T_{Kl\_URA3}$ pdc1::$P_{PDC1}$:Ll_kivD2_coSc5:$P_{FBA1}$:LEU2:$T_{LEU2}$:$P_{ADH1}$:Bs_alsS1_coSc:$T_{CYC1}$:$P_{PGK1}$: Ll_kivD2_coEc:$P_{ENO2}$:Sp_HIS5 pdc5::$T_{Kl\_URA3\_short}$:$P_{FBA1}$:Kl_URA3:$T_{Kl\_URA3}$ pdc6::$P_{TEF}$:Ll_ilvD_coSc_$P_{TDH3}$:Ec_ilvC_coSc$^{P2D1-A1}$: $P_{ENO2}$:Ll_adhA:$P_{FBA1}$:Sc_TRP1 {evolved for C2 supplement-independence, glucose tolerance and faster growth} | pGV2603 + pGV2472 |
| GEVO3881 | Saccharomyces cerevisiae MATa ura3 leu2 his3 trp1 gpd1::$T_{Kl\_URA3}$ gpd2::$T_{Kl\_URA3}$ pdc1::$P_{PDC1}$:Ll_kivD2_coSc5:$P_{FBA1}$:LEU2:$T_{LEU2}$:$P_{ADH1}$:Bs_alsS1_coSc:$T_{CYC1}$:$P_{PGK1}$: Ll_kivD2_coEc:$P_{ENO2}$:Sp_HIS5 pdc5::$T_{Kl\_URA3\_short}$:$P_{FBA1}$:Kl_URA3:$T_{Kl\_URA3}$ pdc6::$P_{TEF}$:Ll_ilvD_coSc_$P_{TDH3}$:Ec_ilvC_coSc$^{P2D1-A1}$: $P_{ENO2}$:Ll_adhA:$P_{FBA1}$:Sc_TRP1 {evolved for C2 supplement-independence, glucose tolerance and faster growth} | pGV2603 + pGV2472 |
| GEVO3928 | Saccharomyces cerevisiae MATa ura3 leu2 his3 trp1 gpd1::$T_{Kl\_URA3}$ gpd2::$T_{Kl\_URA3}$ pdc1::$P_{PDC1}$:Ll_kivD2_coSc5:$P_{FBA1}$:LEU2:$T_{LEU2}$:$P_{ADH1}$:Bs_alsS1_coSc:$T_{CYC1}$:$P_{PGK1}$: Ll_kivD2_coEc:$P_{ENO2}$:Sp_HIS5 pdc5::$T_{Kl\_URA3\_short}$:$P_{FBA1}$:Kl_URA3:$T_{Kl\_URA3}$ pdc6::$P_{TEF}$:Ll_ilvD_coSc_$P_{TDH3}$:Ec_ilvC_coSc$^{P2D1-A1}$: $P_{ENO2}$:Ll_adhA:$P_{FBA1}$:Sc_TRP1 {evolved for C2 supplement-independence, glucose tolerance and faster growth} | pGV2607 + pGV2472 |
| GEVO3929 | Saccharomyces cerevisiae MATa ura3 leu2 his3 trp1 gpd1::$T_{Kl\_URA3}$ gpd2::$T_{Kl\_URA3}$ pdc1::$P_{PDC1}$:Ll_kivD2_coSc5:$P_{FBA1}$:LEU2:$T_{LEU2}$:$P_{ADH1}$:Bs_alsS1_coSc:$T_{CYC1}$:$P_{PGK1}$: Ll_kivD2_coEc:$P_{ENO2}$:Sp_HIS5 pdc5::$T_{Kl\_URA3\_short}$:$P_{FBA1}$:Kl_URA3:$T_{Kl\_URA3}$ pdc6::$P_{TEF}$:Ll_ilvD_coSc_$P_{TDH3}$:Ec_ilvC_coSc$^{P2D1-A1}$: $P_{ENO2}$:Ll_adhA:$P_{FBA1}$:Sc_TRP1 {evolved for C2 supplement-independence, glucose tolerance and faster growth} | pGV2607 + pGV2472 |
| GEVO3930 | Saccharomyces cerevisiae MATa ura3 leu2 his3 trp1 gpd1::$T_{Kl\_URA3}$ gpd2::$T_{Kl\_URA3}$ pdc1::$P_{PDC1}$:Ll_kivD2_coSc5:$P_{FBA1}$:LEU2:$T_{LEU2}$:$P_{ADH1}$:Bs_alsS1_coSc:$T_{CYC1}$:$P_{PGK1}$: Ll_kivD2_coEc:$P_{ENO2}$:Sp_HIS5 pdc5::$T_{Kl\_URA3\_short}$:$P_{FBA1}$:Kl_URA3:$T_{Kl\_URA3}$ pdc6::$P_{TEF}$:Ll_ilvD_coSc_$P_{TDH3}$:Ec_ilvC_coSc$^{P2D1-A1}$: $P_{ENO2}$:Ll_adhA:$P_{FBA1}$:Sc_TRP1 {evolved for C2 supplement-independence, glucose tolerance and faster growth} | pGV2608 + pGV2472 |
| GEVO3931 | Saccharomyces cerevisiae MATa ura3 leu2 his3 trp1 gpd1::$T_{Kl\_URA3}$ gpd2::$T_{Kl\_URA3}$ pdc1::$P_{PDC1}$:Ll_kivD2_coSc5:$P_{FBA1}$:LEU2:$T_{LEU2}$:$P_{ADH1}$:Bs_alsS1_coSc:$T_{CYC1}$:$P_{PGK1}$: Ll_kivD2_coEc:$P_{ENO2}$:Sp_HIS5 pdc5::$T_{Kl\_URA3\_short}$:$P_{FBA1}$:Kl_URA3:$T_{Kl\_URA3}$ pdc6::$P_{TEF}$:Ll_ilvD_coSc_$P_{TDH3}$:Ec_ilvC_coSc$^{P2D1-A1}$: $P_{ENO2}$:Ll_adhA:$P_{FBA1}$:Sc_TRP1 {evolved for C2 supplement-independence, glucose tolerance and faster growth} | pGV2608 + pGV2472 |
| GEVO3932 | Saccharomyces cerevisiae MATa ura3 leu2 his3 trp1 gpd1::$T_{Kl\_URA3}$ gpd2::$T_{Kl\_URA3}$ pdc1::$P_{PDC1}$:Ll_kivD2_coSc5:$P_{FBA1}$:LEU2:$T_{LEU2}$:$P_{ADH1}$:Bs_alsS1_coSc:$T_{CYC1}$:$P_{PGK1}$: | pGV2608 + pGV2472 |

TABLE 11-continued

Genotype of strains disclosed in Example 3.

| GEVO Number | Genotype | Plasmid |
|---|---|---|
| | Ll_kivD2_coEc:P$_{ENO2}$:Sp_HIS5 pdc5::T$_{Kl\_URA3\_short}$:P$_{FBA1}$:Kl_URA3:T$_{Kl\_URA3}$ pdc6::P$_{TEF}$:Ll_ilvD_coSc_P$_{TDH3}$:Ec_ilvC_coSc$^{P2D1-A1}$: P$_{ENO2}$:Ll_adhA:P$_{FBA1}$:Sc_TRP1 {evolved for C2 supplement-independence, glucose tolerance and faster growth} | |

TABLE 12

Plasmids disclosed in Example 3.

| Plasmid Name | Relevant Genes/Usage | Genotype |
|---|---|---|
| pGV2603 | Plasmid pGV2603 is a 2 micron plasmid expressing KARI, Ll_IlvD DHAD, KIVD, and ADH | P$_{TDH3}$:Ec_ilvC_coSc$^{P2D1A1\text{-}his*}$ P$_{TEF1}$:Ll_ilvD_coSc P$_{ENO2}$_Ll_adhA$^{RE1}$ 2μ ori, bla, G418R |
| pGV2607 | Plasmid pGV2607 is a 2 micron plasmid expressing KARI, Nc_IlvD2 DHAD, KIVD, and ADH | P$_{TDH3}$:Ec_ilvC_coSc$^{P2D1A1}$ P$_{TEF1}$:Nc_ilvD_coSc P$_{ENO2}$_Ll_adhA$^{RE1}$ 2μ ori, bla, G418R |
| pGV2608 | Plasmid pGV2608 is a 2 micron plasmid expressing KARI, Sm_IlvD DHAD, KIVD, and ADH | P$_{TDH3}$:Ec_ilvC_coSc$^{P2D1A1}$ P$_{TEF1}$:Sm_ilvD_coSc P$_{ENO2}$_Ll_adhA$^{RE1}$ 2μ ori, bla, G418R |
| pGV2472 | CEN plasmid expressing AFT1 | P$_{TDH3}$: Sc_AFT1 P$_{TEF1}$: empty P$_{PGK1}$: empty CEN ori, bla, HygroR |

*Contains 6-his tags as compared to Ec_ilvC_coSc$^{P2D1A1}$

Shake Flask Fermentations: Fermentations were performed to compare the DHAD enzyme activity of strains GEVO3879, GEVO3880, GEVO3881, GEVO3928, GEVO3929, GEVO3930, GEVO3931 and GEVO3932, which overexpress AFT1 from S. cerevisiae from plasmid pGV2472, with strains GEVO3873, GEVO3874, GEVO3875, GEVO3876, GEVO3877, and GEVO3878, which do not overexpress AFT1. Strains GEVO3873, GEVO3874, GEVO3879, GEVO3880 and GEVO3881 express the Lactococcus lactis IIvD protein (Ll_IlvD) from the Ll_ilvD gene on pGV2603. Strains GEVO3875, GEVO3928 and GEVO3929 express the Neurospora crassa IIvD2 protein (Nc_IlvD2) from the Nc_ilvD2 gene on pGV2607. Strains GEVO3876, GEVO3877, GEVO3878, GEVO3930, GEVO3931 and GEVO3932 express the Streptococcus mutans IIvD protein (Sm_IlvD) from the Sm_ilvD gene on pGV2608. These plasmids were all present in the same host background strain, GEVO3626.

Strains containing plasmid pGV2472 were maintained and grown in media containing both 0.2 g/L G418 and 0.1 g/L hygromycin while strains lacking pGV2472 were maintained and grown in media containing 0.2 g/L G418. Yeast strains were inoculated from cell patches or from purified single colonies from YPD supplemented with 0.2 g/L G418 medium agar plates or from YPD supplemented with 0.2 g/L G418 and 0.1 g/L hygromycin medium agar plates into 3 mL of growth medium in 14 mL round-bottom snap-cap tubes to provide three replicates of strains carrying each plasmid or plasmid combination. The growth media used were YPD+0.2 g/L G418+1% v/v ethanol medium for strains lacking pGV2472 and YPD+0.2 g/L G418+0.1 g/L hygromycin+1% v/v ethanol medium for strains containing pGV2472. The cultures were incubated for up to 24 h shaking at an angle at 250 rpm at 30° C. Separately for each tube culture, these overnight cultures were used to inoculate 50 mL of medium in a 250 mL baffled flask with a sleeve closure to an OD$_{600}$ of 0.1. The media used were YP+50 g/L glucose+0.2 g/L G418+1% v/v ethanol medium for strains lacking pGV2472 and YP+50 g/L glucose+0.2 g/L G418+0.1 g/L hygromycin+1% v/v ethanol medium for strains containing pGV2472. These flask cultures were incubated for up to 24 h shaking at 250 rpm at 30° C. The cells from these flask cultures were harvested separately for each flask culture by centrifugation at 3000 rcf for 5 min and each cell pellet was resuspended separately in 5 mL of YP medium supplemented with 80 g/L glucose, 1% v/v stock solution of 3 g/L ergosterol and 132 g/L Tween 80 dissolved in ethanol, 200 mM MES buffer, pH 6.5, and 0.2 g/L G418. Each cell suspension was used to inoculate 50 mL of YP medium supplemented with 80 g/L glucose, 1% v/v stock solution of 3 g/L ergosterol and 132 g/L Tween 80 dissolved in ethanol, 200 mM MES buffer, pH 6.5, and 0.2 g/L G418 in a 250 mL non-baffled flask with a vented screw-cap to an OD$_{600}$ of approximately 5. These fermentations were incubated shaking at 250 rpm at 30° C. After 73 h of incubation, the cells from half of each fermentation culture were harvested by centrifugation at 3000 rcf for 5 min at 4° C. Each cell pellet was resuspended in 25 mL of cold MilliQ water and then harvested by centrifugation at 3000 rcf for 5 min at 4° C. The supernatant was removed from each pellet and the tubes containing the pellets were frozen at −80° C.

Cell lysate production, total protein quantification, DHAD assays and liquid chromatography, method 2, were performed as described in the general methods.

Overexpression of S. Cerevisiae AFT1 Increased the DHAD Activity of Strains Expressing Different DHAD Enzymes: Overexpression of S. cerevisiae AFT1 increased the DHAD enzyme activity of strains expressing the L. lactis IIvD, N. crassa IIvD2 and S. mutans IIvD DHADs by at least 2.5-fold (Table 13). DHAD enzyme activities of the strains expressing the different DHADs were similar in the absence of AFT1 overexpression but were at different increased enzyme activity levels in the strains expressing the different DHADs together with AFT1 overexpression. This demonstrates that AFT1 overexpression increases the activity of multiple DHAD enzymes from several different organisms.

TABLE 13

DHAD enzyme activity results from shake flask fermentations demonstrating increased DHAD activity from S. cerevisiae expressing DHAD enzymes from L. lactis, N. crassa and S. mutans and overexpressing AFT1.

| | DHAD Enzyme Activity (μmol KIV/min/mg lysate) | |
|---|---|---|
| Expressed DHAD | No AFT1 Overexpression | AFT1 Overexpression |
| Ll_IlvD | 0.27 ± 0.02 | 1.26 ± 0.16 |
| Nc_IlvD2 | 0.29 ± 0.05 | 1.14 ± 0.15 |
| Sm_IlvD | 0.34 ± 0.05 | 0.85 ± 0.08 |

Example 4

Simultaneous Overexpression of AFT1 and AFT2 Increases DHAD Activity

The purpose of this example is to demonstrate that overexpression of *S. cerevisiae* AFT1 (Sc_AFT1) and *S. cerevisiae* AFT2 (Sc_AFT2) increases DHAD activity.

Standard molecular biology methods for cloning and plasmid construction were generally used, unless otherwise noted (Sambrook, J., Russel, D. W. *Molecular Cloning, A Laboratory Manual.* 3 ed. 2001, Cold Spring Harbor, N.Y.: Cold Spring Harbor Laboratory Press). Cloning techniques included gel purification of DNA fragments (using the Zymoclean Gel DNA Recovery Kit, Cat# D4002, Zymo Research Corp, Orange, Calif.).

*S. cerevisiae* Transformations: Co-transformations with the CEN and 2μ plasmids into *S. cerevisiae* strains are described below. Briefly, the *S. cerevisiae* strain GEVO2843 (Table 5) was grown on YPD medium. From the plate, the strain was re-suspended in 100 mM lithium acetate. Once the cells were re-suspended, a mixture of DNA (final volume of 15 μL with sterile water), 72 μL 50% w/v PEG, 10 μL 1 M lithium acetate, and 3 μL of denatured salmon sperm DNA (10 mg/mL) was prepared for each transformation. In a 1.5 mL tube, 15 μL of the cell suspension was added to the DNA mixture (100 μL), and the transformation suspension was vortexed for 5 short pulses. The transformation was incubated for 30 min at 30° C., followed by incubation for 22 min at 42° C. The cells were collected by centrifugation (18,000 rcf., 10 sec, 25° C.). The cells were resuspended in 1 mL YPD and after an overnight recovery shaking at 30° C. and 250 rpm, the cells were spread over YPD supplemented with 0.2 g/L G418 and 0.1 g/L hygromycin selective plates. Transformants were then single colony purified onto G418 and hygromycin selective plates.

Shake Flask Fermentation: Fermentations for the AFT1/AFT2 transformant strains were performed. Starter cultures with each transformed strain were inoculated into 3 mL YPD with 0.1 g/L hygromycin, 0.2 g/L G418, 1% v/v EtOH and incubated shaking at 250 rpm at 30° C. Pre-cultures for the fermentations were inoculated to 0.05 OD$_{600}$ into 50 mL YPD (8% w/v glucose) with 200 mM MES, 0.1 g/L hygromycin, 0.2 g/L G418, 1% v/v stock solution of 3 g/L ergosterol and 132 g/L Tween 80 dissolved in ethanol, and 20 μM CuSO$_4$ at pH 6.5 in 250 mL baffled flasks, shaking at 250 rpm at 30° C. Fermentation cultures were inoculated to 4.0-5.0 OD$_{600}$ into 50 mL YPD (8% w/v glucose) with 200 mM MES, 0.1 g/L hygromycin, 0.2 g/L G418, 1% v/v stock solution of 3 g/L ergosterol and 132 g/L Tween 80 dissolved in ethanol, and 20 μM CuSO$_4$ at pH 6.5 in 250 mL unbaffled flasks, shaking at 75 rpm at 30° C. All cultures were done in biological triplicate.

Preparation of Yeast Lysate: 50 mL of cells were spun down at 4° C., 3000 rcf for 5 min from the 72 hr timepoint of the fermentation. The medium was decanted and the cells were resuspended in 10 mL of cold MilliQ water. The cells were centrifuged a second time at 4° C., 3000 rcf for 5 min. The medium was again decanted and the cells were centrifuged at 4° C., 3000 rcf for 5 min. Remaining media was removed and the cell pellet was frozen at −80° C. Cells were thawed on ice and resuspended in lysis buffer (50 mM Tris pH 8.0, 5 mM MgSO$_4$) such that the result was a 20% cell suspension by mass. 1000 μL of glass beads (0.5 mm diameter) were added to a 1.5 mL microcentrifuge tube and 875 μL of cell suspension was added. Yeast cells were lysed using a Retsch MM301 mixer mill (Retsch Inc. Newtown, Pa.), mixing 6×1 min each at full speed with 1 min incubations on ice between each bead-beating step. The tubes were centrifuged for 10 min at 23,500 rcf at 4° C. and the supernatant was removed for use. The lysates were held on ice until assayed.

DHAD Assay: each sample was diluted in DHAD assay buffer (50 mM Tris pH 8, 5 mM MgSO$_4$) to a 1:10 and 1:100 dilution. Three samples of each lysate were assayed, along with no lysate controls. 10 μL of each sample (or DHAD assay buffer) was added to 0.2 mL PCR tubes. Using a multi-channel pipette, 90 μL of the substrate was added to each tube (substrate mix was prepared by adding 4 mL DHAD assay buffer to 0.5 mL 100 mM DHIV). Samples were put in a thermocycler (Eppendorf Mastercycler) at 35° C. for 30 min followed by a 5 min incubation at 95° C. Samples were cooled to 4° C. on the thermocycler, then centrifuged at 3000 rcf for 5 min. Finally, 75 μL of supernatant was transferred to new PCR tubes and submitted to analytics for analysis by Liquid Chromatography, method 2. Yeast lysate protein concentration was determined as described under General Methods.

Liquid Chromatography, method 2: DNPH reagent (4:1 of 15 mM 2,4-Dinitrophenyl Hydrazine:100 mM Citric Acid pH 3.0) was added to each sample in a 1:1 ratio. Samples were incubated for 30 min at 70° C. in a thermo-cycler (Eppendorf, Mastercycler). Analysis of keto-isovalerate and isobutyraldehyde was performed on an Agilent 1200 High Performance Liquid Chromatography system equipped with an Eclipse XDB C-18 reverse phase column (Agilent) and a C-18 reverse phase column guard (Phenomenex). Ketoisovalerate and isobutyraldehyde were detected using an Agilent 1100 UV detector (360 nm). The column temperature was 50° C. This method was isocratic with 70% acetonitrile 2.5% phosphoric acid (0.4%), 27.5% water as mobile phase. Flow was set to 3 mL/min. Injection size was 10 μL and run time was 2 min.

Results for DHAD Activity: Data is presented as specific DHAD activity (U/mg total cell lysate protein) averages from biological and technical triplicates with standard deviations. DHAD activity in GEVO2843 transformed with pGV2247 (Table 10)+pGV2196 (empty vector, Table 6) was 0.358±0.009 U/mg. DHAD activity for GEVO2843 transformed with pGV2247+pGV2626 (CEN plasmid that contains Sc_AFT1 and Sc_AFT2; Genotype: P$_{TDH3}$:Sc_AFT1, P$_{TEF1}$: empty, P$_{PGK1}$:Sc_AFT2, CEN ori, bla, HygroR) was 0.902±0.032 U/mg. The simultaneous overexpression of Sc_AFT1 and Sc_AFT2 increased the amount of DHAD activity in the strain.

Example 5

AFT1 Expression Increases DHAD Activity Independently of DHAD Protein Levels The following example illustrates that overexpression of the AFT1 gene in *Saccharomyces cerevisiae* leads to increased DHAD activity independently of DHAD protein levels.

TABLE 14

Genotype of strains disclosed in Example 5.

| GEVO No. | Genotype |
|---|---|
| GEVO3882 | MATa ura3 leu2 his3 trp1 gpd1::T$_{Kl\_URA3}$ gpd2::T$_{Kl\_URA3}$tma29::T$_{Kl\_URA3}$ pdc1::P$_{PDC1}$:Ll_kivD2_coSc5:P$_{FBA1}$:LEU2:T$_{LEU2}$:P$_{ADH1}$:Bs_alsS1_coSc:T$_{CYC1}$:P$_{PGK1}$:Ll_kivD2_coEc: P$_{ENO2}$:Sp_HIS5 pdc5::T$_{Kl\_URA3}$ pdc6::T$_{Kl\_URA3\_short}$:P$_{FBA1}$:Kl_URA3:T$_{Kl\_URA3}$ {evolved for C2 supplement-independence, glucose tolerance and faster growth} [pGV2603] |
| GEVO3901 | MATa ura3 leu2 his3 trp1 gpd1::T$_{Kl\_URA3}$ gpd2::T$_{Kl\_URA3}$tma29::T$_{Kl\_URA3}$ pdc1::P$_{PDC1}$:Ll_kivD2_coSc5:P$_{FBA1}$:LEU2:T$_{LEU2}$:P$_{ADH1}$:Bs_alsS1_coSc:T$_{CYC1}$:P$_{PGK1}$:Ll_kivD2_coEc: P$_{ENO2}$:Sp_HIS5 pdc5::T$_{Kl\_URA3}$ pdc6::P$_{TDH3}$:Sc_AFT1:P$_{ENO2}$:Ll_adhA$^{RE1}$:T$_{Kl\_URA3\_short}$:P$_{FBA1}$-Kl_URA3:T$_{Kl\_URA3}$ {evolved for C2 supplement-independence, glucose tolerance and faster growth} [pGV2603] |

Media: Medium used was standard yeast medium (for example Sambrook, J., Russel, D. W. Molecular Cloning, A Laboratory Manual. 3rd ed. 2001, Cold Spring Harbor, N.Y.: Cold Spring Harbor Laboratory Press and Guthrie, C. and Fink, G. R. eds. Methods in Enzymology Part B: Guide to Yeast Genetics and Molecular and Cell Biology 350:3-623 (2002)). YP medium contains 1% (w/v) yeast extract, 2% (w/v) peptone. YPD is YP containing 2% (w/v) glucose.

Fermentations in benchtop fermentors: Fermentations in benchtop fermentors were performed to compare the DHAD enzyme activity and DHAD protein level of GEVO3882 (no AFT1 overexpression) to GEVO3901 (AFT1 overexpression). For these fermentations, 1 mL from thawed frozen stocks of the strains were transferred to 500 mL baffled flasks containing 80 mL of YP medium supplemented with 80 g/L glucose, 5 g/L ethanol, 0.5 g/L MgSO$_4$ and 0.2 g/L G418 and incubated for 24 h at 30° C. in an orbital shaker at 250 rpm. The flask culture for each strain was transferred to duplicate 2-L top drive motor fermentor vessels with a working volume of 0.9 L of YP medium supplemented with 80 g/L glucose, 5 g/L ethanol, 0.5 g/L MgSO$_4$ and 0.2 g/L G418 per vessel for a starting OD$_{600}$ of 0.5. Fermentors were operated at 30° C. and pH 6.0 controlled with 6N KOH and 2N H$_2$SO$_4$ in a 2-phase aerobic condition based on oxygen transfer rate (OTR). Initially, fermentors were operated at a growth phase OTR of 10 mM/h by fixed agitation of 700 rpm and an air overlay of 5 sL/h. Cultures were grown for 20 h to approximately 10-130D$_S$ then immediately switched to a production aeration OTR=0.5 mM/h by reducing agitation from 700 rpm to 300 rpm for the period of 20 h to 70.5 h.

Sample Collection: Samples from each fermentor were collected at 15.5 h, 20 h, 27 h, 48.5 h and 70.5 h to measure optical density at 600 nm (OD$_{600}$). A volume of culture equal to 150 OD600 was then collected from each fermentor at each time point using 60 mL sterile syringes via a sterile sample port on each vessel and placed on ice in 500 mL centrifuge bottles. The samples were centrifuged at 4000 rcf for 10 min at 4° C. to pellet the cells. The cell pellets were then separately resuspended in 60 mL cold deionized water for DHAD enzyme assays or cold deionized water containing Yeast/Fungal Protease Arrest (GBiosciences) for DHAD protein quantification and separated into 10 mL aliquots which were centrifuged at 4000 rcf for 10 min at 4° C. to pellet the cells. The supernatant was removed from each pellet and the resulting cell pellets were stored frozen at −80° C. until used to prepare cell lysates.

Cell Lysate Production: Cell lysates were prepared for each frozen sample pellet in lysis buffer U1, which contains 0.1 M sodium phosphate, pH 7.0, 5 mM MgCl$_2$ and 1 mM DTT, for DHAD enzyme assays or lysis buffer U1 containing Yeast/Fungal Protease Arrest (GBiosciences) for DHAD protein quantification. Each cell pellet was individually suspended to 20% (w/v) in the appropriate lysis buffer and 1 mL of that cell suspension was added together with 1000 µL of 0.5 mm diameter glass beads to a 1.5 mL microcentrifuge tube. The yeast cells were lysed using a Retsch MM301 mixer mill (Retsch Inc., Newtown, Pa.) by mixing for six 1-min cycles at full speed with 1-min incubations on ice between each cycle. The tubes were then centrifuged for 10 min at 23,500 rcf at 4° C. and the supernatant was removed. Samples for DHAD enzyme assays were held on ice until assayed on the same day and samples for DHAD protein quantification were frozen at −20° C. Yeast lysate protein concentration was determined as described under General Methods.

DHAD Assay: Each cell lysate sample was diluted 1:10 in DHAD assay buffer (50 mM Tris, pH 8, 5 mM MgSO$_4$). Three samples of diluted lysate were assayed, along with three controls of DHAD assay buffer containing no lysate. 10 µL of each sample or control was added to 0.2 mL PCR tubes. Using a multi-channel pipette, 90 µL of substrate mix, prepared by adding 4 mL DHAD assay buffer to 0.5 mL 100 mM DHIV, was added to each tube. These tubes were placed in an Eppendorf Mastercycler thermocycler and incubated at 35° C. for 30 min followed by incubation at 95° C. for 5 min then cooled to 4° C. in the thermocycler and centrifuged at 3000 rcf for 5 min. 75 µL of supernatant from each tube was transferred to separate new PCR tubes and submitted for liquid chromatography analysis for keto-isovalerate quantification. The DHAD activity was calculated as µmol KIV produced/min/mg total cell lysate protein in the assay.

Liquid Chromatography for Keto-Isovalerate Quantification: 100 µL of DNPH reagent, containing 12 mM 2,4-dinitrophenyl hydrazine, 10 mM citric acid, pH 3.0, 80% Acetonitrile and 20% MilliQ H$_2$O, was added to 100 µL of each sample. The mixtures were then incubated for 30 min at 70° C. in an Eppendorf Mastercycler thermocycler. Analysis of keto-isovalerate (KIV) was performed on an HP-1200 High Performance Liquid Chromatography system equipped with an Eclipse XDB C-18 reverse phase column (Agilent) and a C-18 reverse phase column guard (Phenomenex). Keto-isovalerate (KIV) was detected using an HP-1100 UV detector at 210 nm. The column temperature was 50° C. This method was isocratic with 70% acetonitrile to water as mobile phase with 2.5% dilute phosphoric acid (4%). Flow was set to 3 mL/min. Injection size was 10 µL and the run time was 2 min.

DHAD Protein Quantification: Cell lysate samples were prepared for gel electrophoresis by mixing with appropriate volumes of 4×LDS loading buffer (Invitrogen) and 10× reducing agent solution (Invitrogen) and MilliQ water, followed by incubation at 70° C. for 10 min. Prepared samples were run on 4-12% acrylamide Bis-Tris gels (Invitrogen) at 200V for 55 min on the Novex Gel Midi System (Invitrogen) and protein was subsequently transferred from the gel to PVDF membrane with the Novex Semi-Dry Blotter(Invitrogen). Gel electrophoresis and protein transfer were performed according to the manufacturer's recommendations. PVDF membranes with transferred proteins were blocked in 2% ECL Advance Blocking Agent (GE Healthcare) diluted in filtered TBST (150 mM NaCl, 10 mM Tris-HCl, pH 7.5, 0.5% v/v Tween 20) for 1 h at room temperature under mild agitation. Membranes were then probed with a 1:500 dilution of rabbit anti-LI_IlvD or a 1:500 dilution of rabbit anti-Sc_Ilv3 serum for 1 h at room temperature under mild agitation. Membranes were washed with filtered TBST for 15 min, followed by three 5 min washes with additional filtered TBST. Membranes were then incubated with a 1:5000 dilution of goat anti-rabbit AlexaFluor 633-tagged secondary antibody (Invitrogen) for 1 h at room temperature under mild agitation while protected from light. Membranes were washed with TBST as described above while protected from light and then were dried and scanned on a Storm 860 fluorescence imaging system (Molecular Dynamics) using the 635 nm laser at 300V and 100 μm resolution. ImageQuant software (GE Healthcare) was used to perform standardized densitometry to quantify relative levels of protein expression, reported as integrated band intensity from the blots.

Overexpression of AFT1 Increases DHAD Activity Without Increasing

DHAD Protein Levels: DHAD enzyme activity and DHAD protein levels from benchtop fermentor fermentations are summarized in Tables 15 and 16. AFT1-overexpressing strain GEVO3901 contains at least 1.5-fold higher DHAD enzyme activity at all fermentation sample time points compared with strain GEVO3882 with no AFT1 overexpression (Table 15). The ratio of DHAD enzyme activity in GEVO3901 overexpressing AFT1 compared to DHAD enzyme activity in strain GEVO3882 with no AFT1 overexpression was higher during the growth phase of the fermentation (3.7 at 15.5 h, 3.8 at 20 h) than during the production phase of the fermentation (2.8 at 27 h, 1.5 at 48.5 h and 1.8 at 70.5 h).

DHAD protein levels from AFT1-overexpressing strain GEVO3901 were not substantially different from strain GEVO3882 with no AFT1 overexpression at any of the fermentation sample time points (Table 16). Neither the LI_IlvD nor the Sc_Ilv3 DHAD protein levels were substantially different from GEVO3901 overexpressing AFT1 compared with GEVO3882 without AFT1 overexpression at any fermentation sample time point.

TABLE 15

DHAD enzyme activity results from fermentation samples demonstrating increased DHAD activity with AFT1 overexpression.

| | DHAD Enzyme Activity (μmol KIV/min/mg lysate protein) | |
| --- | --- | --- |
| Time of Sample | No AFT1 Overexpression (GEVO3882) | AFT1 Overexpression (GEVO3901) |
| 15.5 h | 0.060 ± 0.007 | 0.224 ± 0.009 |
| 20.5 h | 0.076 ± 0.003 | 0.286 ± 0.064 |
| 27 h | 0.119 ± 0.049 | 0.338 ± 0.020 |
| 48.5 h | 0.262 ± 0.026 | 0.386 ± 0.078 |
| 70.5 h | 0.367 ± 0.021 | 0.652 ± 0.083 |

TABLE 16

DHAD protein level determinations from fermentation samples demonstrating no increase in DHAD protein levels with AFT1 overexpression.

| | LI_IlvD DHAD Protein Level (Integrated Band Intensity) | | Sc_Ilv3 DHAD Protein Level (Integrated Band intensity) | |
| --- | --- | --- | --- | --- |
| Time of Sample | No AFT1 Overexpression | AFT1 Overexpression | No AFT1 Overexpression | AFT1 Overxpression |
| 15.5 h | 11941 ± 870 | 11144 ± 821 | 206 ± 47 | 227 ± 20 |
| 20.5 h | 10339 ± 830 | 10634 ± 749 | 225 ± 108 | 260 ± 52 |
| 27 h | 10057 ± 636 | 10065 ± 816 | 256 ± 37 | 244 ± 74 |
| 48.5 h | 9803 ± 114 | 9956 ± 273 | 158 ± 6 | 180 ± 41 |
| 70.5 h | 10010 ± 341 | 11212 ± 1922 | 181 ± 15 | 268 ± 25 |

Example 6

Mutating Sc_AFT1 or Sc_AFT2 to Sc_AFT1$^{UP}$ or Sc_AFT2$^{UP}$ Alleles

A point mutation in Sc_Aft1 and Sc_Aft2 causes derepression of transcriptional activation in the presence of iron. Sc_Aft1-1$^{UP}$ mutation changes Cys291Phe (Yamaguchi-Iwia et al. 1995 *EMBO Journal* 14: 1231-9). The Sc_Aft2-1$^{UP}$ mutation changes Cys187Phe (Rutherford et al. 2001 *PNAS* 98: 14322-7). The purpose of this example is to demonstrate that mutating the endogenous copy of Sc_AFT1 or Sc_AFT2 into the Sc_AFT1-1$^{UP}$ or Sc_AFT2-1$^{UP}$ mutant alleles generally mimics the overexpression of Sc_AFT1 or Sc_AFT2 by increasing DHAD activity and isobutanol titers in yeast strains carrying an isobutanol producing metabolic pathway.

Figure 3:
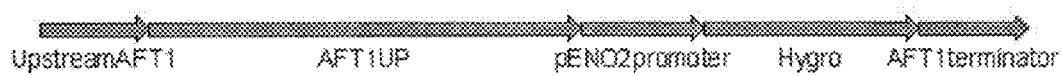
FIG. 3 illustrates a *S. cerevisiae* AFT1-1$^{UP}$ allelic exchange construct.
Figure 4:
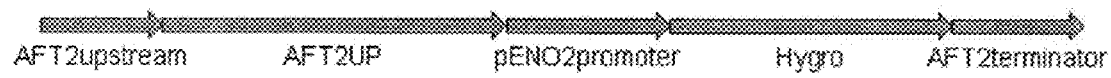
FIG. 4 illustrates a *S. cerevisiae* AFT2-1$^{UP}$ allelic exchange construct.

In this example, Sc_AFT1 and Sc_AFT2 are replaced in the genome by Sc_AFT1-1$^{UP}$ and Sc_AFT2-1$^{UP}$ alleles, either individually or together. FIGS. 3 and 4 show the constructs for the allelic replacement for Sc_AFT1-1$^{UP}$ (SEQ ID NO: 62) and Sc_AFT2-1$^{UP}$ (SEQ ID NO: 63). These constructs are synthesized by DNA2.0. The constructs are transformed into GEVO2843 (Table 5) either with pGV2227 (Table 6) or pGV2196 (empty vector control, Table 6) to yield GEVO6209 and GEVO6210 (Table 17).

Yeast Transformations: Transformations of either the linear Sc_AFT1-1$^{UP}$ or the Sc_AFT2-1$^{UP}$ constructs or pGV2227 (or pGV2196) into GEVO2483 are described below. Briefly, the *S. cerevisiae* strain GEVO2843 is grown on YPD medium. The strain is re-suspended in 100 mM lithium acetate. Once the cells are re-suspended, a mixture of DNA (final volume of 15 μL with sterile water), 72 μL 50% w/v PEG, 10 μL 1 M lithium acetate, and 3 μL of denatured salmon sperm DNA (10 mg/mL) is prepared for each transformation. In a 1.5 mL tube, 15 μL of the cell suspension is added to the DNA mixture (100 μL), and the transformation suspension is vortexed for 5 short pulses. The transformation is incubated for 30 min at 30° C., followed by incubation for 22 min at 42° C. The cells are collected by centrifugation (18,000 rcf, 10 sec, 25° C.). The cells are resuspended in 1 mL YPD and after an overnight recovery shaking at 30° C. and 250 rpm, the transformants are spread over YPD supplemented with 0.2 g/L G418 selective plates. Transformants are then single colony purified onto G418 selective plates. GEVO2483 containing pGV2227 or pGV2196 and transformed with the linear AFT$^{UP}$ constructs are plated onto YPD with 0.2 g/L G418 and 0.1 g/L hygromycin.

TABLE 17

Genotype of strains disclosed in Example 6.

| GEVO Number | Genotype |
| --- | --- |
| GEVO6209 | S. cerevisiae CEN.PK2, MATa ura3 leu2 his3 trp1 pdc1Δ::$P_{CUP1}$:[Bs_alsS1_coSc:$T_{CYC1}$; $P_{PGK1}$: Ll_kivD2_coEc: $P_{ENO2}$: Sp_HIS5] pdc5Δ::[LEU2:bla:$P_{TEF1}$: ILV3ΔN20: $P_{TDH3}$: Ec_ilvC_coSc$^{Q110V}$] pdc6Δ::[URA3: bla; $P_{TEF1}$: Ll_kivD2_coEC: $P_{TDH3}$: Dm_ADH] aft1 Δ::[$P_{AFT1}$:AFT1-1$^{UP}$:$P_{ENO2}$:G418] {evolved for C2 supplement-independence, glucose tolerance and faster growth}. |
| GEVO6210 | S. cerevisiae CEN.PK2, MATa ura3 leu2 his3 trp1 pdc1Δ::$P_{CUP1}$:[Bs_alsS1_coSc:$T_{CYC1}$; $P_{PGK1}$: Ll_kivD2_coEc: $P_{ENO2}$: Sp_HIS5] pdc5Δ::[LEU2:bla:$P_{TEF1}$: ILV3ΔN20: $P_{TDH3}$: Ec_ilvC_coSc$^{Q110V}$] pdc6Δ::[URA3: bla; $P_{TEF1}$: Ll_kivD2_coEC: $P_{TDH3}$: Dm_ADH] aft2 Δ:: [$P_{AFT2}$:AFT2-1$^{UP}$: $P_{ENO2}$:G418] {evolved for C2 supplement-independence, glucose tolerance and faster growth} |

Strains that grow on 0.2 g/L G418 and 0.1 g/L hygromycin are further screened by PCR to determine if the integration has replaced Sc_AFT1 or Sc_AFT2.

For AFT1: The primer AFT1UP forward (SEQ ID NO: 64) is used with the primer pENO2R (SEQ ID NO: 65) to yield a 599 base pair product that will not be present in the parental strain. The primer AFT1UP forward is used with primer AFT1termR (SEQ ID NO: 66) to ensure that the parental Sc_AFT1 does not remain in the strain. If integrated correctly, these primers give an approximately 2210 base pair product; if the parental Sc_AFT1 remains in the strain the product size is 584 base pairs. Finally, the Sc_AFT1-1$^{UP}$ gene is amplified using the AFT1 UPfullF (SEQ ID NO: 67) and pENO2R primers. This product is submitted for sequencing using the AFT1UPsequence1 (SEQ ID NO: 68) and AFT1UPsequence2 (SEQ ID NO: 69) primers to ensure that the proper mutation is in the genome.

For AFT2: Primer AFT2Upforward (SEQ ID NO: 70) is used with primer pENO2R to yield an approximately 350 base pair product that will not be present in the parental strain. Primer AFT2UP forward is used with primer AFT2termR (SEQ ID NO: 71) to ensure that the parental Sc_AFT2 does not remain in the strain. If integrated correctly these primers give an approximately 1819 base pair product. If the parental Sc_AFT2 remains in the strain the product size is 195 base pairs. Finally, the Sc_AFT2-1$^{UP}$ gene is amplified using the AFT2UPfullF (SEQ ID NO: 72) and pENO2R primers. This product is submitted for sequencing using the AFT2UPsequence1 (SEQ ID NO: 73) and AFT2UPsequence2 (SEQ ID NO: 74) primers to ensure that the proper mutation is in the genome.

Preparation of Yeast Cells: Yeast strains are grown in 50 mL YPD with 0.2 g/L G418 (if carrying the AFT$^{UP}$ allele) to mid-log phase (1-3 OD$_{600}$). A volume of cells so that 20 OD$_{600}$ of cells are acquired are spun down at 4° C., 3000 rcf for 5 min. The medium is decanted and the cells are resuspended in 10 mL of cold MilliQ water. The cells are centrifuged a second time at 4° C., 3000 rcf for 5 min. The medium is again decanted and the cells are centrifuged at 4° C., 3000 rcf for 5 min. The remaining medium is removed and the cell pellet is frozen at −80° C.

DHAD Assays are performed as described in the general methods section. Yeast lysate protein concentration was determined as described in the general methods section.

Gas Chromatography, Liquid chromatography method 1 and liquid chromatography method 2 are performed as described in the general methods section.

Shake-Flask Fermentation: Fermentations for the AFT1-1$^{UP}$ and AFT2-1$^{UP}$ transformant strains are performed. Starter cultures with each transformed strain are inoculated into 3 mL YPD with 0.2 g/L G418 and 1% v/v EtOH and incubated shaking at 250 rpm at 30° C. Pre-cultures for the fermentations are inoculated to 0.05 OD$_{600}$ into 50 mL YPD (8% w/v glucose) with 200 mM MES, 0.2 g/L G418, 1% v/v stock solution of 3 g/L ergosterol and 132 g/L Tween 80 dissolved in ethanol, and 20 μM CuSO$_4$ at pH 6.5 in 250 mL baffled flasks, shaking at 250 rpm at 30° C. Fermentation cultures are inoculated to 5.0 OD$_{600}$ into 50 mL YPD (8% w/v glucose) with 200 mM MES, 0.2 g/L G418, 1% v/v stock solution of 3 g/L ergosterol and 132 g/L Tween 80 dissolved in ethanol, and 20 μM CuSO$_4$ at pH 6.5 in 250 mL unbaffled flasks, shaking at 75 rpm at 30° C. All cultures are done in biological triplicate. Samples are collected at 24, 48 and 72 h and analyzed using the liquid chromatography, method 1, and gas chromatography protocols.

Results for DHAD activity: Data is presented as specific DHAD activity (U/mg total cell lysate protein) averages from biological and technical triplicates with standard deviations. DHAD activity in GEVO2843 transformed with pGV2227 is generally expected to be lower than that of GEVO2843+ pGV2227 transformed with either the Sc_AFT1-1$^{UP}$ or Sc_AFT2-1$^{UP}$ allele.

Results for Isobutanol Fermentation: Data is presented as specific isobutanol titer (g/L/O$_{D600}$); averages from biological and technical triplicates with standard deviations. Isobutanol titers in GEVO2843 transformed with pGV2227 is generally expected to be lower than that of GEVO2843+ pGV2227 transformed with either the Sc_AFT1-1$^{UP}$ or Sc_AFT2-1$^{UP}$ allele.

Example 7

Overexpression of AFT1 in *S. Cerevisiae* Carrying an Isobutanol Producing Metabolic Pathway Increases AFT Regulon Genes as Measured by mRNA The purpose of this example is to demonstrate that overexpression of AFT1 in strains expressing an isobutanol producing metabolic pathway increases the expression of genes in the AFT regulon in fermentation vessels. This in turn increases DHAD activity and isobutanol titer, productivity, and yield.

Media: Medium used was standard yeast medium (for example Sambrook, J., Russel, D. W. Molecular Cloning, A Laboratory Manual. 3rd ed. 2001, Cold Spring Harbor, N.Y.: Cold Spring Harbor Laboratory Press and Guthrie, C. and Fink, G. R. eds. Methods in Enzymology Part B: Guide to Yeast Genetics and Molecular and Cell Biology 350:3-623 (2002)). YP medium contains 1% (w/v) yeast extract, 2% (w/v) peptone. YPD is YP containing 2% (w/v) glucose. Medium used for the fermentation was YP with 80 g/L glucose, 0.2 g/L G418, 0.1 g/L hygromycin, 100 μM $CuSO_4.5H_2O$ and 1% v/v ethanol. The medium was filter sterilized using a 1 L bottle top Corning PES 0.22 μm filter (431174). Medium was pH adjusted to 6.0 in the fermenter vessels using 6N KOH.

Fermentation vessel preparation and operating conditions: Batch fermentations were conducted using six 2 L top drive motor DasGip vessels with a working volume of 0.9 L per vessel. Vessels were sterilized, along with the appropriate dissolved oxygen probes and pH probes, for 60 min at 121° C. pH probes were calibrated prior to sterilization, however, dissolved oxygen probes were calibrated post sterilization in order to allow for polarization.

Process control parameters: Initial volume, 900 mL. Temperature, 30° C. pH 6.0, pH was controlled using 6N KOH and 2N $H_2SO_4$ (Table 20).

TABLE 18

Process Control Parameters.

| | | |
|---|---|---|
| Growth phase | Oxygen transfer rate | 10 mM/h |
| | Air overlay | 5.0 slph |
| | Agitation | 700 rpm |
| | Dissolved oxygen | Not controlled |
| Fermentation phase | Oxygen transfer rate | 0.5 mM/h to 1.8 mM/h* |
| | Air overlay | 5.0 slph |
| | Agitation | 300 rpm/400 rpm* |
| | Dissolved oxygen | Not controlled |

*Oxygen transfer rate increased from 0.5 mM/h to 1.8 mM/h by increase in agitation from 300 rpm to 400 rpm 56 h post inoculation.

Fermentation: The fermentation was run for 119 h. Vessels were sampled 3 times daily. Sterile 5 mL syringes were used to collect 3 mL of fermenter culture via a sterile sample port. The sample was placed in a 2 mL microfuge tube and a portion was used to measure cell density ($OD_{600}$) on a Genesys 10 spectrophotometer (Thermo Scientific). An additional 2 mL portion was taken in the same manner as described above, for use in qRT-PCR analysis. This sample was spun in a microcentrifuge for 1 min at 14,000 rpm.

Yeast Transformations: Co-transformations with the CEN and 2p plasmids are described below. Briefly, the S. cerevisiae strain GEVO2843 (Table 5) was grown on YPD medium. The strain was re-suspended in 100 mM lithium acetate. Once the cells were re-suspended, a mixture of DNA (final volume of 15 μL with sterile water), 72 μL 50% w/v PEG, 10 μL 1 M lithium acetate, and 3 μL of denatured salmon sperm DNA (10 mg/mL) was prepared for each transformation. In a 1.5 mL tube, 15 μL of the cell suspension was added to the DNA mixture (100 μL), and the transformation suspension was vortexed for 5 short pulses. The transformation was incubated for 30 min at 30° C., followed by incubation for 22 min at 42° C. The cells were collected by centrifugation (18,000 rcf, 10 sec, 25° C.). The cells were resuspended in 1 mL YPD and after an overnight recovery shaking at 30° C. and 250 rpm, the cells were spread over YPD supplemented with 0.2 g/L G418 and 0.1 g/L hygromycin selective plates. Transformants were then single colony purified onto G418 and hygromycin selective plates.

RNA preparation: RNA was isolated using the YeaStar RNAKit™ (Zymo Research Corp. Orange, Calif.). Cells were resuspended in 80 μl of YR Digestion Buffer, 1 μl RNAsin (Promega, Madison, Wis.) and 5 μl of Zymolyase™ (provided with YeaStar RNAKit). The pellet was completely resuspended by repeated pipetting. The suspension was incubated at 37° C. for 60 min. Following the incubation, 160 μl of YR Lysis Buffer was added to the suspension, which was then mixed thoroughly by vortexing. The mixture was centrifuged at 7,000 g for 2 min in a microcentrifuge, and the supernatant was transferred to a Zymo-Spin Column in a collection tube. The column was centrifuged at 10,000 g for 1 min in a microcentrifuge. To the column, 200 μl RNA Wash Buffer was added, and the column was centrifuged for 1 min at full speed in a microcentrifuge. The flow-through was discarded and 200 μl RNA Wash Buffer was added to the column. The column was centrifuged for 1 min at 14,000 g in a microcentrifuge. The Zymo-Spin Column was transferred to a new RNase-free 1.5 mL centrifuge tube, and 60 μl of DNase/RNase-free water was added directly to the column membrane and let stand for 1 min at room temperature. The RNA was eluted by centrifugation for 1 min at full speed in the microcentrifuge. Concentrations were determined by measuring the $OD_{260}$ with the Nanoprop spectrophotometer (Thermo Scientific, Waltham, Mass. 02454). RNA was stored at −80° C. until use.

qRT-PCR analysis: RNA prepared from the fermentation samples (at a dilution of 5 ng/μl) was used as a template for one-step quantitative RT-PCR using the qScript One-Step SYBR Green qRT-PCR kit (Quanta Biosciences™ Gaithersburg, Md.). Each PCR reaction contained 10 ng of RNA, 0.5 μL of 10 μM forward primer, 0.5 μL of 10 μM reverse primer, 6.1 μL of sterile water, and 10 μL of the One-Step SYBR Green Master Mix, 0.5 μL RNAsin, and 0.4 μL of qScript One-Step Reverse Transcriptase. qRT-PCR was done in triplicate for each sample. For the purpose of normalizing the experimental samples, qRT-PCR was also done for the TFC1 housekeeping gene. Primers used to target the AFT regulon genes and for the TFC1 gene are presented in Table 19. The reactions were incubated in an Eppendorf Mastercycler ep thermocycler (Eppendorf, Hamburg, Germany) using the following conditions: 50° C. for 10 min, 95° C. for 5 min, 40 cycles of 95° C. for 15 sec and 60° C. for 45 sec (amplification), then 95° C. for 15 sec, 60° C. for 15 sec, and a 20 min slow ramping up of the temperature until it reaches 95° C. (melting curve analysis). The fluorescence emitted by the SYBR dye was measured at the 60° C. incubation step during each of the 40 cycles, as well as during the ramping up to 95° C. for melting curve analysis of the PCR product.

TABLE 19

Primers used for qRT-PCR analysis to target the AFT regulon.

| Target | Primer | Sequence |
|---|---|---|
| TFC1 | 2649 | TCCAGGCGGTATTGACAGCAGG (SEQ ID NO: 75) |
| | 2650 | CAATCTGCAACATCAGGTACCACGG (SEQ ID NO: 76) |
| AFT1 | 2962 | ACGCCAACATCTTCGCAACACTC (SEQ ID NO: 77) |
| | 2963 | TGCCGGCAGTGGCAAGATTTC (SEQ) ID NO: 78) |
| AFT2 | 2966 | CCTCTTCAAGATCCCATGCATGTCC (SEQ ID NO: 79) |
| | 2967 | TGTAACCGCACAGAGTAGGCTGC (SEQ ID NO: 80) |

TABLE 19-continued

Primers used for qRT-PCR analysis to target the AFT regulon.

| Target | Primer | Sequence |
|---|---|---|
| FET3 | 2972 | TGGCCACTGAAGGTAACGCCG (SEQ ID NO: 81) |
|  | 2973 | CCGGTAGGAATGAAGGCATGCTG (SEQ ID NO: 82) |
| ENB1 | 2976 | TGGCGCTGAGATTGTGGTCGG (SEQ ID NO: 83) |
|  | 2977 | TGAAGCGTGCACTAGCGTCC (SEQ ID NO: 84) |
| SMF3 | 2978 | TGCCGGGCAAATCGTTTCTGAG (SEQ ID NO: 85) |
|  | 2979 | CTTGTGGCCCAAGGTGGTAAAGACC (SEQ ID NO: 86) |

Standard molecular biology methods for cloning and plasmid construction were generally used, unless otherwise noted (Sambrook, J., Russel, D. W. *Molecular Cloning, A Laboratory Manual.* 3 ed. 2001, Cold Spring Harbor, N.Y.: Cold Spring Harbor Laboratory Press).

Cloning techniques included gel purification of DNA fragments (using the Zymoclean Gel DNA Recovery Kit, Cat# D4002, Zymo Research Corp, Orange, Calif.).

GEVO2843 (Table 5) was co-transformed with two plasmids. GEVO3342 (Table 8) has plasmids pGV2227 (Table 6) and pGV2196 (empty vector, Table 6); GEVO3343 (Table 8) has plasmids pGV2227 (Table 6) and pGV2472 (Table 6—contains Sc_AFT1).

In Table 20, the fold change data was normalized to the strain without Sc_AFT1 overexpression at 24 h. Thus, all data points for the strain without Sc_AFT1 overexpression at 24 h have been set to one. The overexpression of Sc_AFT1 in *S. cerevisiae* strains increased predicted Sc_AFT1 target genes, ENB1 (SEQ ID NO: 123) and FET3 (SEQ ID NO: 91). SMF3 (SEQ ID NO: 159) is predicted to be more dependent on Sc_AFT2 for expression and SMF3 had a much weaker response to the overexpression of Sc_AFT1, as can be seen in Table 20.

TABLE 20

Fold change in mRNA expression between strains with and without Sc_AFT1 overexpressed.

|  | Expression at 24 h | | Expression at 119 h | |
|---|---|---|---|---|
| qRT-PCR target | Without overexpression of Sc_AFT1 | With overexpression of Sc_AFT1 | Without overexpression of Sc_AFT1 | With overexpression of Sc_AFT1 |
| AFT1 | 1.00 | 16.17 | 0.83 | 7.29 |
| AFT2 | 1.00 | 1.02 | 0.86 | 0.79 |
| ENB1 | 1.00 | 18.00 | 0.83 | 7.59 |
| FET3 | 1.00 | 31.89 | 0.92 | 10.16 |
| SMF3 | 1.00 | 5.37 | 1.23 | 3.23 |

Overexpression of Sc_AFT1 increased gene expression of targeted genes in the AFT regulon. As shown in Example 1, the increased expression of Sc_AFT1 in these strains also caused increased isobutanol titers, production rates and yields and DHAD activity in fermentations. Thus, it is likely that one or more genes in the AFT regulon impacts DHAD activity and isobutanol production.

Example 8

Overexpression of Specific Genes in the AFT1 and AFT2 Regulons

The purpose of this example is to demonstrate that a specific gene or genes from the AFT1 or AFT2 regulon are important for an increase in DHAD activity and isobutanol production.

Standard molecular biology methods for cloning and plasmid construction are generally used, unless otherwise noted (Sambrook, J., Russel, D. W. *Molecular Cloning, A Laboratory Manual.* 3 ed. 2001, Cold Spring Harbor, N.Y.: Cold Spring Harbor Laboratory Press).

Media: Medium used is described in the general methods section. Cloning techniques include gel purification of DNA fragments (using the Zymoclean Gel DNA Recovery Kit, Cat# D4002, Zymo Research Corp, Orange, Calif.).

AFT1 and AFT2 regulon genes presented in Table 21 are synthesized by DNA 2.0 (Menlo Park, Calif., USA) removing any HpaI or SaCI restriction sites within the genes. The synthesized AFT regulon genes are cloned behind the PGK1 promoter in pGV2196 (empty vector—Table 6) creating a series of 50 plasmids that are co-transformed with pGV2227 (Table 6) into *S. cerevisiae* strain GEVO2843 (Table 5). Isobutanol production from strain GEVO2843 containing pGV2227 has been shown to be limited by DHAD activity. Thus, this provides a suitable background for detecting increases in DHAD activity and subsequent increases in the production of a metabolite from a DHAD-requiring biosynthetic pathway, such as an isobutanol producing metabolic pathway.

TABLE 21

Genes in the AFT1 and AFT2 Regulon For Screening DHAD Activity

| Gene name | Gene (SEQ ID NO) | Protein (SEQ ID NO) |
|---|---|---|
| FIT3 | SEQ ID NO: 87 | SEQ ID NO: 88 |
| FIT1 | SEQ ID NO: 89 | SEQ ID NO: 90 |
| FET3 | SEQ ID NO: 91 | SEQ ID NO: 92 |
| FRE1 | SEQ ID NO: 93 | SEQ ID NO: 94 |
| FTR1 | SEQ ID NO: 95 | SEQ ID NO: 96 |
| FIT2 | SEQ ID NO: 97 | SEQ ID NO: 98 |
| COT1 | SEQ ID NO: 99 | SEQ ID NO: 100 |
| OYE3 | SEQ ID NO: 101 | SEQ ID NO: 102 |
| TIS11/CTH2 | SEQ ID NO: 103 | SEQ ID NO: 104 |
| VMR1 | SEQ ID NO: 105 | SEQ ID NO: 106 |
| AKR1 | SEQ ID NO: 107 | SEQ ID NO: 108 |
| BIO5 | SEQ ID NO: 109 | SEQ ID NO: 110 |
| YOR387C | SEQ ID NO: 111 | SEQ ID NO: 112 |
| YDR271C | SEQ ID NO: 113 | SEQ ID NO: 114 |
| YMR034C | SEQ ID NO: 115 | SEQ ID NO: 116 |
| FRE2 | SEQ ID NO: 117 | SEQ ID NO: 118 |
| ARN1 | SEQ ID NO: 119 | SEQ ID NO: 120 |
| ATX1 | SEQ ID NO: 121 | SEQ ID NO: 122 |
| ENB1/ARN4 | SEQ ID NO: 123 | SEQ ID NO: 124 |
| SIT1/ARN3 | SEQ ID NO: 125 | SEQ ID NO: 126 |
| ARN2 | SEQ ID NO: 127 | SEQ ID NO: 128 |
| TAF1/TAF130/TAF145 | SEQ ID NO: 129 | SEQ ID NO: 130 |
| FRE5 | SEQ ID NO: 131 | SEQ ID NO: 132 |
| FRE6 | SEQ ID NO: 133 | SEQ ID NO: 134 |
| FRE3 | SEQ ID NO: 135 | SEQ ID NO: 136 |
| BNA2 | SEQ ID NO: 137 | SEQ ID NO: 138 |
| ECM4/GTO2 | SEQ ID NO: 139 | SEQ ID NO: 140 |
| HSP26 | SEQ ID NO: 141 | SEQ ID NO: 142 |
| YAP2/CAD1 | SEQ ID NO: 143 | SEQ ID NO: 144 |
| LAP4/APE1/YSC1/API | SEQ ID NO: 145 | SEQ ID NO: 146 |
| ECL1 | SEQ ID NO: 147 | SEQ ID NO: 148 |
| OSW1 | SEQ ID NO: 149 | SEQ ID NO: 150 |
| NFT1 | SEQ ID NO: 151 | SEQ ID NO: 152 |
| YBR012C | SEQ ID NO: 153 | SEQ ID NO: 154 |

TABLE 21-continued

Genes in the AFT1 and AFT2 Regulon For Screening DHAD Activity

| Gene name | Gene (SEQ ID NO) | Protein (SEQ ID NO) |
|---|---|---|
| YOL083W | SEQ ID NO: 155 | SEQ ID NO: 156 |
| ARA2 | SEQ ID NO: 157 | SEQ ID NO: 158 |
| SMF3 | SEQ ID NO: 159 | SEQ ID NO: 160 |
| MRS4 | SEQ ID NO: 161 | SEQ ID NO: 162 |
| ISU1/NUA1 | SEQ ID NO: 163 | SEQ ID NO: 164 |
| FET4 | SEQ ID NO: 165 | SEQ ID NO: 166 |
| FET5 | SEQ ID NO: 167 | SEQ ID NO: 168 |
| FTH1 | SEQ ID NO: 169 | SEQ ID NO: 170 |
| CCC2 | SEQ ID NO: 171 | SEQ ID NO: 172 |
| FRE4 | SEQ ID NO: 173 | SEQ ID NO: 174 |
| ISU2 | SEQ ID NO: 175 | SEQ ID NO: 176 |
| HMX1 | SEQ ID NO: 177 | SEQ ID NO: 178 |
| PCL5 | SEQ ID NO: 179 | SEQ ID NO: 180 |
| ICY2 | SEQ ID NO: 181 | SEQ ID NO: 182 |
| PRY1 | SEQ ID NO: 183 | SEQ ID NO: 184 |
| YDL124w | SEQ ID NO: 185 | SEQ ID NO: 186 |

Yeast Transformations are performed as described in the general methods section.

Preparation of Yeast Cells for Enzyme Assays: Yeast Strains are Grown in 50 mL YPD with 0.2 g/L G418 and 0.1 g/L hygromycin to mid-log phase (1-3 $OD_{600}$). A volume of cells so that 20 $OD_{600}$ of cells are acquired are spun down at 4° C., 3000 rcf for 5 min. The medium is decanted and the cells are resuspend in 10 mL of cold MilliQ water. The cells are centrifuged a second time at 4° C., 3000 rcf for 5 min. The medium is again decanted and the cells are centrifuged at 4° C., 3000 rcf for 5 min. The remaining media is removed and the cell pellet is frozen at −80° C.

Preparation of Yeast Lysate for Enzyme Assays: Cell Pellets are Thawed on ice. Y-PER Plus reagent (Thermo Scientific #78999) is added to each pellet at a ratio of 12.5 µL of reagent per one OD of cells and the cells resuspended by vortexing. The suspension is gently agitated for 20 min at room temperature. After 20 min, a volume equal to the Y-PER Plus volume of universal lysis buffer (0.1 M Sodium Phosphate, pH 7.0, 5 mM $MgCl_2$, 1 mM DTT) is added. The suspension is shaken for another 40 min. Samples are centrifuged at 5300 g for 10 min at room temperature. The clarified lysates are transferred to a fresh tube and kept on ice until assayed.

DHAD Assays are performed as described in the general methods section.

Yeast lysate protein concentration was determined as described in the general methods section.

Gas Chromatography, liquid chromatography method 1 and liquid chromatography method 2 are performed as described in the general methods section.

Shake-Flask Fermentation: Fermentations with the AFT regulon gene transformant strains are performed. Starter cultures with each transformed strain are inoculated into 3 mL YPD supplemented with 0.2 g/L G418 and 1% v/v EtOH and incubated shaking at 250 rpm at 30° C. Pre-cultures for the fermentations are inoculated to 0.05 $OD_{600}$ into 50 mL YPD (8% w/v glucose) with 200 mM MES, 0.2 g/L G418, 1% v/v stock solution of 3 g/L ergosterol and 132 g/L Tween 80 dissolved in ethanol, and 20 µM $CuSO_4$ at pH 6.5 in 250 mL baffled flasks, shaking at 250 rpm at 30° C. Fermentation cultures are inoculated to 5.0 $OD_{600}$ into 50 mL YPD (8% w/v glucose) with 200 mM MES, 0.2 g/L G418, 1% v/v stock solution of 3 g/L ergosterol and 132 g/L Tween 80 dissolved in ethanol, and 20 µM $CuSO_4$ at pH 6.5 in 250 mL unbaffled flasks, shaking at 75 rpm at 30° C. All cultures are done in biological triplicate. Samples are collected at 24, 48 and 72 h and analyzed using the liquid chromatography, method 1, and gas chromatography protocols.

Results for DHAD activity: Data is presented as specific DHAD activity (U/mg total cell lysate protein) averages from biological and technical triplicates with standard deviations. DHAD activity in GEVO2843 transformed with pGV2227+ pGV2196 (empty vector) is generally expected to be lower than that of GEVO2843 transformed with either AFT1 or AFT2 genes. In addition, GEVO2843 transformed with pGV2227 and clones containing AFT regulon genes that are important for increasing DHAD activity will generally have similar or higher DHAD activity to GEVO2843 transformed with pGV2227 and the AFT1 or AFT2 genes.

Results for Isobutanol Fermentation: Data is presented as specific isobutanol titer (g/L/$OD_{600}$); averages from biological and technical triplicates with standard deviations. Isobutanol titers in GEVO2843 transformed with pGV2227+ pGV2196 (empty vector) are generally expected to be lower than that of GEVO2843 transformed with either AFT1 or AFT2 genes. In addition, GEVO2843 transformed with pGV2227 and clones containing AFT regulon genes that are important for increasing DHAD activity will generally have similar or higher isobutanol titers to GEVO02843 transformed with pGV2227 and AFT1 or AFT2.

Example 9

Overexpression of the *Kluyveromyces lactis* AFT Increases DHAD Activity in *K. Lactis*

The purpose of this example is to demonstrate that overexpression of AFT from *K. lactis* increases DHAD activity in *K. lactis*.

Standard molecular biology methods for cloning and plasmid construction were generally used, unless otherwise noted (Sambrook, J., Russel, D. W. *Molecular Cloning, A Laboratory Manual*. 3 ed. 2001, Cold Spring Harbor, N.Y.: Cold Spring Harbor Laboratory Press).

Cloning techniques included gel purification of DNA fragments (using the Zymoclean Gel DNA Recovery Kit, Cat# D4002, Zymo Research Corp, Orange, Calif.).

Strains and plasmids used in Example 9 are described in Tables 22 and 23, respectively.

TABLE 22

Genotype of strains disclosed in Example 9.

| GEVO Number | Genotype |
|---|---|
| *K. lactis* GEVO1287 | MATalpha uraA1 trp1 leu2 lysA1 ade1 lac4-8 [pKD1] |
| *K. lactis* GEVO4378 | MATalpha uraA1 trp1 leu2 lysA1 ade1 lac4-8 [pKD1] + pGV2273 |
| *K. lactis* GEVO6169 | MATalpha uraA1 trp1 leu2 lysA1 ade1 lac4-8 [pKD1] + pGV2273 Random integrant of KL_AFT and G418. Linear fragment from plasmid pGV2962 - cut: SalI, BglII, PfoI |

TABLE 23

Plasmids disclosed in Example 9.

| Plasmid Name | Relevant Genes/Usage | Genotype |
|---|---|---|
| pGV2273 | Plasmid pGV2273 is a 1.6 micron vector that expresses KARI, | $P_{TDH3}$: Ec_ilvC_coSc$^{P2DT-A1}$ $P_{TEF1}$: Ll_ilvD_coSc |

TABLE 23-continued

Plasmids disclosed in Example 9.

| Plasmid Name | Relevant Genes/Usage | Genotype |
|---|---|---|
| | KIVD, DHAD and ADH, encodes hygromycin resistance. | $P_{PGK1}$: Ll_kivD2_coEc $P_{ENO2}$: Ll_adhA 1.6µ ori, bla, HygroR |
| pGV2796 | A CEN plasmid carrying used as a backbone for creating pGV2962 and pGV2963. | $P_{TEF1}$: Ll_ilvD_coSc $P_{TPI1}$: G418 $P_{ENO2}$: Ll_adhA$^{RE1}$ CEN ori, bla |
| pGV2962 | A CEN plasmid carrying Ll_ilvD, Kl_AFT genes, and G418 resistance. The plasmid was used to create linearization fragments for integration into K. lactis. | $P_{TEF1}$: Ll_ilvD_coSc $P_{TPI1}$: G418 $P_{ENO2}$: KL_AFT CEN ori, bla |

K. lactis strains: K. lactis strain GEVO1287 was transformed with pGV2273 to form GEVO4378. KL_AFT was PCR amplified from template DNA from strain GEVO4378 using primers oGV3432 (SEQ ID NO: 189) (contains KpnI) and oGV3433 (SEQ ID NO: 190) (contains AvrII). Plasmid pGV2796 and the KL_AFT PCR product were cut with KpnI and AvrII and ligated together to form plasmid pGV2962. The linear fragment containing KI_AFT:G418 was obtained by the restriction digest of pGV2962 with restriction enzymes, SalI, Bg/II and PfoI. The linear KI_AFT:G418 (SEQ ID NO: 201) fragment was randomly integrated by transformation into GEVO4378 to make GEVO6169.

Yeast transformations—K. lactis: K. lactis strain GEVO1287 or GEVO4378 was inoculated into a 3 mL YPD culture and incubated overnight at 250 rpm and 30° C. A 50 mL YPD culture in a baffled 250 mL shake flask was inoculated and shaken at 30° C. until the K. lactis strain GEVO1287 reached an $OD_{600}$ of 0.83 and K. lactis strain GEVO4378 reached an $OD_{600}$ of 0.79. Cells were made chemically competent by the following procedure. Cells were collected by centrifugation at 2700 rcf for 2 min. To wash, cells were re-suspended with 50 mL of sterile milliQ water and again centrifuged at 2700 rcf for 2 min. The wash was repeated by re-suspending cells with 25 mL sterile milliQ water, cells were collected by centrifugation at 2700 rcf for 2 min. Finally the cells were resuspend with 1 mL 100 mM lithium acetate (LiOAc) and transferred to sterile 1.5 mL microcentrifuge tube. Cells were then collected by centrifugation in microfuge (set to max speed) for 10 sec. The supernatant was removed and the cells were re-suspended with 4 times the pellet volume of 100 mM LiOAc. Once the cells were prepared, a mixture of DNA (approximately 1 ug for linear DNA fragment and about 500 ng of plasmid DNA, was brought to 15 µL with sterile water), 72 µL 50% w/v PEG, 10 µL 1 M lithium acetate, and 3 µL of denatured salmon sperm DNA (10 mg/mL) was prepared for each transformation. In a 1.5 mL tube, 15 µL of the cell suspension was added to the DNA mixture (100 µL), and the transformation suspension was vortexed for 5 short pulses. The transformation was incubated for 30 min at 30° C., followed by incubation for 22 min at 42° C. The cells were collected by centrifugation (18,000 rcf, 10 sec, 25° C.). The cells were resuspended in 1 mL YPD and, after an overnight recovery shaking at 30° C. and 250 rpm, 200 µL of the GEVO1287 transformation was spread over YPD supplemented with 0.1 g/L hygromycin. 200 µL of the GEVO4378 transformation was spread over YPD supplemented with 0.1 g/L hygromycin and 0.2 g/L G418. Transformants were selected at 30° C. Transformants were then single colony purified onto either hygromycin and G418 or hygromycin selective plates.

Preparation of Yeast Lysate: K. lactis strains GEVO4378 and GEVO6169 were inoculated into 3 mL of YPD with 0.1 g/L hygromycin and incubated at 30° C. at 250 rpm overnight culture. After approximately 18 h a 50 mL YPD or YPD+0.1 g/L hygromycin culture in a baffled 250 mL shake flask was inoculated and shaken at 250 rpm until the culture reached approximately 2-3 $OD_{600}$. 20 $OD_{600}$ of cells were harvested in 15 mL Falcon tubes and centrifuged at 4° C., 3000 rcf for 5 min. The medium was decanted and the cells were re-suspended in 2 mL of ice-cold MilliQ water. The cells were centrifuged a second time at 4° C., 3000 rcf for 5 min. The supernatant was again decanted, and the cells were centrifuged at 4° C., 3000 rcf for 5 min. The remaining medium was removed. The cell pellet was frozen at −80° C. The cell pellets were thawed on ice and 750 µL of lysis buffer (0.1 M Sodium Phosphate, pH 7.0, 5 mM $MgCl_2$, 1 mM DTT) was used to re-suspend each pellet. 800 µL of re-suspended cell pellet was added to a 1.5 mL centrifuge tube with 1 mL of 0.5 mm glass beads. The tubes containing the glass beads and cell suspension were put into the two bead beater blocks chilled to −20° C. The Retsch MM301 bead beater was set to 1 min and 300 1/sec frequency. To lyse the cells, the cell suspensions were beat 6 times for 1 min each, with 2 min of cooling the tubes and the bead beater blocks on ice in between beatings. After bead beating, the tubes were centrifuged at 4° C. at 21,500 g for 10 min in a tabletop centrifuge. The supernatant was transferred into 1.5 mL tubes and placed on ice for use in the DHAD assay. Yeast lysate protein concentration was determined as described under General Methods.

DHAD Assay: The assay was performed in triplicate for each sample. In addition, a no lysate control with lysis buffer was included. To assay each sample, 10 µL of a 1:10 dilution of lysate in lysis buffer (0.1 M Sodium Phosphate, pH 7.0, 5 mM $MgCl_2$, 1 mM DTT) was mixed with 90 µL of assay buffer (5 µL of 0.1 M $MgSO_4$, 10 µL of 0.1 M DHIV, and 75 µL 50 mM Tris pH 7.5), and incubated in a thermocycler for 30 min at 30° C., then at 95° C. for 5 min. Insoluble material was removed from the samples by centrifugation at 3000 rcf for 5 min. The supernatants are transferred to fresh PCR tubes and submitted to analytics for analysis by liquid chromatography, method 2.

Liquid Chromatography, Method 2: DNPH reagent (4:1 of 15 mM 2,4-Dinitrophenyl Hydrazine:100 mM Citric Acid pH 3.0) was added to each sample in a 1:1 ratio. Samples were incubated for 30 min at 70° C. in a thermo-cycler (Eppendorf, Mastercycler). Analysis of keto-isovalerate was performed on an Agilent 1200 High Performance Liquid Chromatography system equipped with an Eclipse XDB C-18 reverse phase column (Agilent) and a C-18 reverse phase column guard (Phenomenex). Ketoisovalerate were detected using an Agilent 1100 UV detector (360 nm). The column temperature was 50° C. This method was isocratic with 70% acetonitrile 2.5% phosphoric acid (0.4%), 27.5% water as mobile phase. Flow was set to 3 mL/min. Injection size was 10 µL and run time was 2 min.

DHAD Assay Results: The in vitro DHAD enzymatic activity of lysates from the microaerobic fermentation of K. lactis strains was determined as described above. All values are the specific DHAD activity (U/mg total cell lysate protein) as averages from technical triplicates. In K. lactis, overexpression of the KI_AFT gene resulted in an increase in DHAD activity (U/mg total cell lysate protein). GEVO4378 without KI_AFT overexpression had an activity of 0.053±0.009 U/mg while GEVO6169, overexpressing KI_AFT had a specific activity of 0.131±0.012 U/mg.

Example 10

Overexpression of the *Kluyveromyces Marxianus* AFT

The purpose of this example is to demonstrate that overexpression of *K. marxianus* AFT (Km_AFT) is generally expected to increase DHAD activity in *K. marxianus*.

Standard molecular biology methods for cloning and plasmid construction are generally used, unless otherwise noted (Sambrook, J., Russel, D. W. *Molecular Cloning, A Laboratory Manual*. 3 ed. 2001, Cold Spring Harbor, N.Y.: Cold Spring Harbor Laboratory Press). Cloning techniques include gel purification of DNA fragments (using the Zymoclean Gel DNA Recovery Kit, Cat# D4002, Zymo Research Corp, Orange, Calif.).

Strains used in Example 10 are described in Table 24.

TABLE 24

Genotype of strains disclosed in Example 10.

| GEVO Number | Genotype |
| --- | --- |
| *K. marxianus* GEVO1068 | *K. marxianus*, NRRL-Y7571 |
| *K. marxianus* GEVO1947 | ura3Δ |
| *K. marxianus* GEVO6222 | ura3Δ Random integration of: $P_{KmPDC}$:Ll_ilvD:$P_{TPI}$:G418:$P_{PGK1}$:Km_AFT:T:$_{ScAFT}$ |
| *K. marxianus* GEVO6223 | Δura3 Random integration of: $P_{KmPDC}$:Ll_ilvD:$P_{TPI}$:G418:$P_{PGK1}$ |

In this example, the *K. marxianus* URA3 gene was deleted by transformation of GEVO1068 with a PCR fragment (SEQ ID NO: 191) of *K. marxianus* URA3 carrying a deletion of 348 base pairs that was amplified from pGV1799 (SEQ ID NO: 192) using primers oGV394 (SEQ ID NO: 193) and oGV395 (SEQ ID NO: 194). The *K. marxianus* ura3 deletion strain transformants were selected by plating on 5-FOA (5-fluoroorotic acid) plates (For 500 mL: 10 g agar, 400 mL dH$_2$O, 0.5 g 5-FOA (in 5 mL DMSO), 50 mL 10Xa.a (14 g yeast synthetic drop-out supplement (US Biological) dissolved in 1 L water), 3.35 g YNB, 10 g glucose, 10 mL 50×HIS (0.95 g histidine/250 mL H$_2$O), 10 mL 50×TRP (1.9 g in 500 mL H$_2$O), 10 mL 10×LEU (4.75 g Leucine/250 mL H$_2$O), 3.15 mL 25×URA (0.475 g uracil/250 mL H$_2$O). The 5-FOA resistant colonies were confirmed for the correct phenotype (auxotrophic for uracil). PCR demonstrated a partial deletion of approximately 200 by in the ura3 gene and this strain was named GEVO1947.

Figure 5:
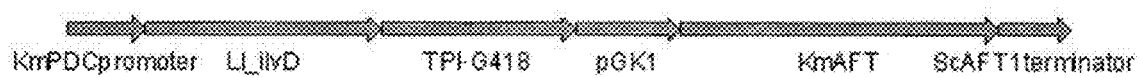
FIG. 5 illustrates a linear DNA fragment containing the *K. marxianus* AFT, the *L. lactis* DHAD, and a G418 resistance marker.
Figure 6:
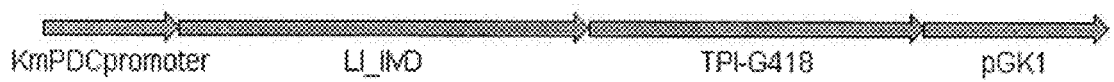
FIG. 6 illustrates a linear DNA fragment containing the *L. lactis* DHAD and a G418 resistance marker.

A linear DNA fragment containing Km_AFT, Ll_ilvD, and a G418 resistance marker (SEQ ID NO: 195, FIG. 5) is synthesized by DNA2.0. The fragment is randomly integrated by transformation into *K. marxianus* strain GEVO1947 to obtain GEVO6222. A linear fragment containing Ll_ilvD and a G418 marker is also synthesized by DNA2.0 (SEQ ID NO: 196, FIG. 6) and is randomly integrated by transforming *K. marxianus* strain GEVO1947 to obtain GEVO6223.

Transformations are carried out as follows: *K. marxianus* strain GEVO1947 is incubated in 50 mL of YPD medium (1% (w/v) yeast extract, 2% (w/v) peptone, 2% (w/v) glucose) shaking at 250 RPM at 30° C. until the culture is at an OD$_{600}$ of approximately 5. The cells are collected in a sterile 50 mL conical tube by centrifugation (1600 rcf, 5 min at room temperature). The cells are then resuspended in 10 mL of electroporation buffer (10 mM Tris-HCl, 270 mM sucrose, 1 mM MgCl$_2$, pH 7.5), and collected at 1600 rcf for 5 min at room temperature. The cells are then resuspended in 10 mL IB (YPD medium, 25 mM DTT, 20 mM HEPES, pH 8.0; prepared fresh by diluting 100 µL of 2.5M DTT and 200 µL of 1 M HEPES, pH 8.0 into 10 mL of YPD) and are incubated for 30 min, 250 RPM, 30° C. (tube standing vertical). The cells are collected at 1600 rcf for 5 min at room temperature and resuspended in 10 mL of chilled electroporation buffer. The cells are then pelleted at 1600 rcf for 5 min at 4° C. The cells are then resuspended in 1 mL of chilled electroporation buffer and transferred to a microfuge tube. The cells are collected by centrifugation at >10,000 rcf for 20 sec at 4° C. The cells are then resuspended in an appropriate amount of chilled electroporation buffer for a final biomass concentration of 30 OD$_{600}$/mL. 400 µL of cell suspension is added to a chilled electroporation cuvette (0.4 cm gap) and 50 µL of DNA (SEQ ID NO: 195 or SEQ ID NO: 196 or water control) is added and mixed by pipetting up and down, and the cuvette is incubated on ice for 15-30 min. The samples are then electroporated at 1.8 kV, 1000 Ohm, 25 µF. The samples are transferred to a 50 mL tube with 1 mL YPD medium, and the samples are incubated for 4 h at 250 rpm at 30° C. 200 µL of each transformation culture are spread onto YPD plates containing 0.2 g/L G418 and the plates are incubated at 30° C. until individual colonies develop.

*K. marxianus* strain GEVO6222 is verified by colony PCR for the integration of Km_AFT using primers PGK1F (SEQ ID NO: 197) and KmAFTR (SEQ ID NO: 198) (yielding an approximately 325 base pair product) and integration of Ll_ilvD using primers oGV2107 (SEQ ID NO: 199) and oGV2108 (SEQ ID NO: 200) (yielding an approximately 104 base pair product). *K. marxianus* strain GEVO6223 is verified by colony PCR for the integration of Ll_IlvD using primers oGV2107 and oGV2108.

Next, *K. marxianus* strains GEVO1947, GEVO6222 and GEVO6223 are inoculated into 3 mL of YPD medium (1% (w/v) yeast extract, 2% (w/v) peptone, 2% (w/v) glucose) and incubated at 30° C. at 250 rpm. After approximately 18 h, a 50 mL YPD culture in a baffled 250 mL shake flask is inoculated and shaken at 250 rpm until the culture reaches approximately 2-3 OD$_{600}$. Cell pellets are prepared by taking 20 OD units of culture [OD$_{600nm}$× volume (mL)=20] and centrifuging the appropriate volume at 3000 rpm and 4° C. for 5 min. The medium is decanted and the cells are resuspended in 2 mL of ice-cold MilliQ water. The cells are centrifuged a second time at 4° C., 3000 rcf for 5 min. The supernatant is again decanted, and the cells are centrifuged at 4° C., 3000 rcf for 5 min. The remaining medium is removed. The cell pellet is frozen at −80° C. To prepare lysate, the cell pellets are thawed on ice and 750 µL of lysis buffer (0.1 M Sodium Phosphate, pH 7.0, 5 mM MgCl$_2$, 1 mM DTT) is used to re-suspend each pellet. 800 µL of re-suspended cell pellet is added to a 1.5 mL centrifuge tube with 1 mL of 0.5 mm glass beads. The tubes containing the glass beads and cell suspension are put into the two bead beater blocks chilled to −20° C. A Retsch MM301 bead beater is set to 1 min and 300 1/sec frequency. To lyse the cells, the cell suspensions are beat 6 times for 1 min each, with 2 min of cooling the tubes and the bead beater blocks on ice in between beatings. After bead beating, the tubes are centrifuged at 4° C. at 21,500 g for 10 min in a tabletop centrifuge. The supernatant is transferred into 1.5 mL tubes and placed on ice for use in the DHAD activity assay. Yeast lysate protein concentration is determined as described under General Methods.

DHAD assays are performed as described in the general methods sectionLiquid chromatography method 2 is performed as described in the general methods section.

Results for DHAD activity: Data is presented as specific DHAD activity (U/mg total cell lysate protein) averages from biological and technical triplicates with standard deviations. DHAD activity in GEVO6223, containing DHAD is generally expected to be lower than that of GEVO6222 containing both Km_AFT and DHAD.

Example 11

Construction of *Issatchenkia Orientalis* Strain with Isobutanol Pathway Genes Integrated into the Genome The purpose of this example is to demonstrate that overexpression of Issatchenkia orientalis AFT1-2 (herein referred to as Io_AFT1-2) increases DHAD activity in *I. orientalis*.

An *I. orientalis* strain derived from PTA-6658 (US 2009/0226989) was grown overnight and transformed using the lithium acetate method as described in Gietz, et al (1992, *Nucleic Acids Research* 20: 1524). The strain was transformed with homologous integration constructs using native *I. orientalis* promoters to drive protein expression. Issatchenkia orientalis strains used are described in Table 25.

mL baffled flasks to an $OD_{600}$ of 0.01. The flasks were incubated at 30° C. and 250 RPM for 18 h. A total of 80 $OD_{600}$ of cells were harvested and the cell suspension was transferred to 50 mL Falcon tubes. Cells were pelleted at 3000 rcf for 5 min at 4° C., and washed twice in 2 mL cold, sterile water. The cell pellets were stored at −80° C. until analysis by DHAD assay.

In the second condition, cultures were inoculated at a starting $OD_{600}$ of 0.1 and were incubated at 30° C. with 250 rpm shaker speed for 20 h and then the shaker speed was reduced to 75 rpm for an additional 28 h prior to sampling. Cells were washed twice with cold sterile water and stored at −80° C. until analysis.

To determine DHAD activity in whole cell lysates, the frozen cell pellets were thawed on ice and resuspended in 750 µL lysis buffer (100 mM $NaPO_4$ pH 7.0, 5 mM $MgCl_2$ and 1 mM DTT). One mL of glass beads (0.5 mm diameter) were added to a 1.5 mL microcentrifuge tube and the entire cell suspension for each strain was added to seperate tubes containing glass beads. Yeast cells were lysed using a Retsch MM301 bead beater (Retsch Inc. Newtown, Pa.), bead beating six times for 1 min each at full speed with 1 min icing in

TABLE 25

Genotype of strains disclosed in Example 11.

| Strain Number | Genotype |
|---|---|
| GEVO6155 | ura3/ura3<br>gpd1Δ::$P_{Io\_PDC}$: Ll_adhA$^{RE1}$: $T_{ScCYC1}$: $P_{Io\_TDH3}$: Ec_ilvC$^{P2D1-A1}$: $T_{ScGAL10}$: loxP: Io_URA3:<br>loxP: $P_{Io\_ENO1}$: Ll_ilvD-1/<br>gpd1Δ:: $P_{Io\_PDC}$:Ll_adhA$^{RE1}$: $T_{ScCYC1}$: $P_{Io\_TDH3}$: Ec_ilvC$^{P2D1-A1}$: $T_{ScGAL10}$: loxP:<br>Sc_MEL5: loxP: $P_{Io\_ENO1}$:Ll_ilvD-1<br>TMA29/tma29Δ::$P_{Io\_PDC1}$:Ll_adhA$^{RE1}$:$P_{Io\_TDH3}$:Ec_ilvC$^{P2D1-A1}$: loxP: Io_URA3: loxP:<br>$P_{Io\_ENO1}$: Ll_ilvD-4 |
| GEVO6162 | ura3/ura3<br>gpd1Δ::$P_{Io\_PDC}$: Ll_adhA$^{RE1}$: $T_{ScCYC1}$: $P_{Io\_TDH3}$: Ec_ilvC$^{P2D1-A1}$: $T_{ScGAL10}$: loxP: Io_URA3:<br>loxP: $P_{Io\_ENO1}$: Ll_ilvD-1/<br>gpd1Δ:: $P_{Io\_PDC}$:Ll_adhA$^{RE1}$: $T_{ScCYC1}$: $P_{Io\_TDH3}$: Ec_ilvC$^{P2D1-A1}$: $T_{ScGAL10}$: loxP:<br>Sc_MEL5: loxP: $P_{Io\_ENO1}$:Ll_ilvD-1 (SEQ ID NO: 204)<br>TMA29/tma29Δ:: $P_{Io\_PDC1}$: Ll_adhA$^{RE1}$: $P_{Io\_TDH3}$: Ec_ilvC$^{P2D1-A1}$: loxP: Io_URA3: loxP:<br>$P_{ENO1}$:Ll_ilvD-4 (SEQ ID NO: 206): $P_{PYK1}$:Io_AFT1-2 |
| GEVO6203 | ura3/ura3<br>gpd1Δ::$P_{Io\_PDC}$: Ll_adhA$^{RE1}$: $T_{ScCYC1}$: $P_{Io\_TDH3}$: Ec_ilvC$^{P2D1-A1}$: $T_{ScGAL10}$: loxP: Io_URA3:<br>loxP: $P_{Io\_ENO1}$: Ll_ilvD/<br>gpd1Δ:: $P_{Io\_PDC}$:Ll_adhA$^{RE1}$: $T_{ScCYC1}$: $P_{Io\_TDH3}$: Ec_ilvC$^{P2D1-A1}$: $T_{ScGAL10}$: loxP:<br>Sc_MEL5: loxP: $P_{Io\_ENO1}$:Ll_ilvD<br>TMA29/tma29Δ:: $P_{Io\_PDC1}$: Ll_adhA$^{RE1}$: $P_{Io\_TDH3}$:Ec_ilvC$^{P2D1-A1}$: loxP: Io_URA3: loxP:<br>$P_{ENO1}$:Ll_ilvD: $P_{PYK1}$:Io_AFT1-2 |

Three strains were used to demonstrate that the overexpression of *I. orientalis* AFT1-2 increases DHAD activity in *I. orientalis*. GEVO6155 does not contain the heterologous AFT1-2 expression construct, while both GEVO6162 and GEVO6203 have the heterologous AFT1-2 construct integrated into the genome. All three strains were cultured in two different conditions and then tested for DHAD activity.

In the first condition, cultures were started for each strain (GEVO6155, GEVO6162, and GEVO6203) in 12 mL YP medium (1% (w/v) yeast extract, 2% (w/v) peptone) containing 5% (w/v) glucose and incubated at 30° C. and 250 RPM for 9 h. The $OD_{600}$ of the 12 mL cultures was determined and the appropriate volume of each culture was used to inoculate 50 mL of YP medium containing 8% glucose in separate 250 between each bead beating step. The tubes were centrifuged for 10 min at 23,500×g at 4° C. and the supernatant was removed. Supernatants were held on ice until assayed. Yeast lysate protein concentration was determined as described under General Methods.

DHAD assays were performed in triplicate for each sample. In addition, an assay on a no lysate control with lysis buffer was performed. To assay each sample, 10 µL of lysate in assay buffer was mixed with 90 µL of assay buffer (5 µL of 0.1 M $MgSO_4$, 10 µL of 0.1 M DHIV, and 75 µL 50 mM Tris pH 7.5), and incubated in a thermocycler (Eppendorf, Mastercycler) for 30 min at 30° C., then at 95° C. for 5 min. Insoluble material was removed from the samples by centrifugation at 3000 rcf for 5 min. The supernatants were transferred to fresh PCR tubes. 100 µL DNPH reagent (12 mM 2,4-dinitrophenyl hydrazine, 10 mM citric acid, pH 3.0, in 80% acetonitrile, 20% MilliQ $H_2O$) was added to 50 µL of each sample and 50 µL of MilliQ $H_2O$, Samples were incubated for 30 min at 70° C. in a thermocycler.

Analysis of keto-isovalerate (KIV) was performed on an Agilent 1200 High Performance Liquid Chromatography system equipped with an Eclipse XDB C-18 reverse phase column (Agilent) and a C-18 reverse phase column guard (Phenomenex). Ketoisovalerate was detected using an Agilent 1100 UV detector (360 nm). The column temperature was 50° C. This method was isocratic with 70% acetonitrile 2.5% phosphoric acid (0.4%), 27.5% water as mobile phase. Flow was set to 3 mL/min. Injection size was 10 µL and run time was 2 min. KIV was quantified on a 3-point linear calibration curve.

The in vitro DHAD enzymatic activity of lysates from the samples of I. orientalis strains were carried out as described above. DHAD activity (U/mg total cell lysate protein) is reported as averages from biological triplicate samples. In *I. orientalis*, overexpression of the *I. orientalis* AFT1-2 gene resulted in an increase in DHAD activity (U/mg total cell lysate protein). The cultures harvested at 18 h (samples inoculated at 0.01) had DHAD activity values as follows: GEVO6155 had an activity of 0.039±0.004 U/mg while GEVO6162 had an activity of 0.082±0.005 U/mg and GEVO6203 had an activity of 0.060±0.011 U/mg. The cultures harvested at 48 h (cultures inoculated at 0.1) had DHAD activity values as follows: GEVO6155 had an activity of 0.085±0.014 U/mg while GEVO6162 had an activity of 0.155±0.020 U/mg and GEVO6203 had an activity of 0.140±0.033 U/mg. Therefore, this example demonstrates that overexpression of Io_AFT1-2 increases DHAD activity in *I. orientalis*.

Example 12

Overexpression of Fe—S Assembly Machinery

To ascertain the effects of overexpressing a cytosolic 2Fe-2S or 4Fe-4S cluster-containing DHAD with candidate assembly machinery, the following steps, or equivalent steps can be carried out. First, the coding sequence for the open reading frame of the DHAD from spinach or other 2Fe-2S or 4Fe-4S cluster-containing DHAD is cloned into the high-copy (2 micron origin) *S. cerevisiae* expression vector pGV2074, such that expression of the coding sequence is directed by the PGK1 promoter sequence, yielding plasmid pGV2074-1. Next, the NifU and NifS genes. from *Entamoeba histolytica* or the homologous NIF genes from *Lactococcus lactis* are successively introduced into the aforementioned vector, eventually yielding a single plasmid (pGV2074-2) where the expression of all 3 genes is directed by strong constitutive *S. cerevisiae* promoter sequences. Plasmids pGV2074-1 and pGV2074-2 are transformed into *S. cerevisiae* strain GEVO2244 (relevant genotype, ilv3Δ) and transformants selected by resistance to Hygromycin B (0.1 g/L). At least 3 individual colonies arising from each transformation are cultured, a cell lysate produced, and the DHAD activity present therein measured, all according to previously-described methods.

The foregoing detailed description has been given for clearness of understanding only and no unnecessary limitations should be understood there from as modifications will be obvious to those skilled in the art.

While the invention has been described in connection with specific embodiments thereof, it will be understood that it is capable of further modifications and this application is intended to cover any variations, uses, or adaptations of the invention following, in general, the principles of the invention and including such departures from the present disclosure as come within known or customary practice within the art to which the invention pertains and as may be applied to the essential features hereinbefore set forth and as follows in the scope of the appended claims.

The disclosures, including the claims, figures and/or drawings, of each and every patent, patent application, and publication cited herein are hereby incorporated herein by reference in their entireties.

SEQUENCE LISTING (225 sequences)

SEQ ID NO: 1 - DNA, 2073 bp, Saccharomyces cerevisiae
atggaaggcttcaatccggctgacatagaacatgcgtcaccgattaattcatctgacagccattcatcctcctttgtatatgctctacccaaaagtgctagtgaatatgtagtcaaccataatgagggtcgtgcaagtgcaagtggaaatccagccgcagtgccgtctcccataatgacactgaatctcaaaagcacacattccctcaatattgatcagcatgttcatacctcaacatcgccgacggaaactattgggcatattcatcatgtggaaaagctgaatcaaaacaatttgattcatctggatccagtacccaactttgaagataagtccgatattaagccttggttgcaaaagattttttatcctcaaggaatagaacttgtgatagaaaggtcggacgcatttaaagttgtcttcaagtgtaaagctgctaaaaggggaaggaacgcgagaaggaaaagaaaagataagcccaaaggacaggaccacgaagacgagaaatccaagatcaatgatgacgaattagaatatgcgagtccttctaatgccacagtaaccaatgggcctcaaacatcgcccgatcaaacatcctccataaagccaaagaaaaaaagatgtgtatcgaggtttaataactgtccgtttagagtacgagctacttattcgttaaagaggaaaagatggagcattgttgtaatggacaataaccattcacatcagctaaagtttaaccctgattccgaagagtacaaaaaattcaaagaaaaattaagaaaggataatgacgtagatgcaatcaagaaattcgacgaattggaatacagaactttggccaatttgcccattccaacagctacaatcccctgtgattgtggtttaacaaatgaaatacaaagtttcaatgtcgtattgcccactaacagtaatgttacttcatcagcatcctcttcaactgtatcgtccatatcccttgattcatcgaatgcatctaaaaggccatgcttaccctctgtaaataacaccggtagtatcaataccaataacgtaaggaaaccgaaaagccagtgtaagaataaagacacactcttaaaaagaaccaccatgcagaactttctcacaactaaatcaaggctgcgtaagaccggtacgccaacatcttcgcaacactcatctacagcattttcaggatatattgatgatcctttcaatttgaatgaaatcttgccactgccggcatccgatttcaagctaaacactgtaacaaatttgaacgaaattgactttacgaacatttttaccaaatcgccgcatccacatagcgggtctacccatccaagacaagtcttcgaccaattggacgattgttcctctatactcttctctccattaactacaaacacgaataatgaatttgaaggagagtcagatgattttgttcattctccatatttgaactcagaggcagatttcagccaaattcttagtagtgctcccccagtccatcatgacccaaatgaaacacatcaggaaaaccaggatattattgatagatttgctaatagttcccaagaacataatgagtatattctacaatatttgacgcactccgatgctgctaaccacaataacatcggcgttccaaacaacaattcacattcgctaaatactcagcataacgtttctgatctgggcaactcacttttaagacaagaagctttagttggcagctcttcaacaaaaatcttcgacgaattgaaatttgtacaaaatggcccacacggttctcaacatcctatagattttcaacatgttgaccatcgtcatctcagctctaatgaacctcaagtacgatcacatcaatatggtccgcaacagcagccaccgcagcaattgcaatatcaccaaaatcagccccacgacggccataaccacgaacagcaccaaacagtacaaaaggatatgcaaacgcatgaatcgctagaaataatgggaaacacattattggaagagttcaaagacattaaaatggtgaacggcgagttgaagtatgtgaagccagaagattag

SEQ ID NO: 2 - protein, 690 aa, Saccharomyces cerevisiae
MEGFNPADIEHASPINSSDSHSSSFVYALPKSASEYVVNHNEGRASASGNPAAVPSPIMTLNLKSTHSLNIDQHVHTSTSPTETIGHIHHVEKLNQNNLIHLDPVPNFEDKSDIKPWLQKIFYPQGIELVIERSDAFKVVFKCKAAKRGRNARRKRKDKPKGQDHEDEKSKINDDELEYASPSNATVTNGPQTSPDQTSSIKPKKKRCVSRFNNCPFRVRATYSLKRKRWSIVVMDNNHSHQLKFNPDSEEYKKFKEKLRKDNDVDAIKKFDELEYRTLANLPIPTATIPCDCGLTNEIQSFNVVLPTNSNVTSSASSSTVSSISLDSSNASKRPCLPSVNNTGSINTNNVRKPKSQCKNKDTLLKRTTMQNFLTTKSRLRKTGTPTSSQHSSTAFSGYIDDPFNLNEILPLPASDFKLNTVTNLNEIDFTNIFTKSPHPHSGSTHPRQVFDQLDDCSSILFSPLTTNTNNEFEGESDDFVHSPYLNSEADFSQILSSAPPVHHDPNETHQENQDIIDRFANSSQEHNEYILQYLTHSDAANHNNIGVPNNNSHSLNTQHNVSDLGNSLLRQEALVGSSSTKIFDELKFVQNGPHGSQHPIDFQHVDHRHLSSNEPQVRSHQYGPQQQPPQQLQYHQNQPHDGHNHEQHQTVQKDMQTHESLEIMGNTLLEEFKDIKMVNGELKYVKPED

SEQ ID NO: 3 - DNA, 1251 bp, Saccharomyces cerevisiae
atgaaagcaaagtcgatgaagagcataatatctgtgccaatatcagtgtctaaaacagggaaaatgaagttaacagcatctcccgataatctagcatctatgatgtctaaagaccaaaataaacttattcatttagacccagttccgtcttttgaggacaggcacgagattaaaccgtggctacagaaaatattctatcctcaaggaatagatatagtcatcgaaagatcagatagtagcaaagttacttttaagtgtaggtcagtacgatcgaaagtagggttgaaccctaaatccaaaggttcctcttcaagatcccatgcatgtccatttagaattagagcagcctactctgtgcggttacagaagtggaacgtggttgttatgaataacatacattcacatgagctgagatttgatttgattactaaaacggatgactataaaaagtttaaggaaaatcttcgtcagaagaacgacgaaaaagccatcaaaacatttgatgaattagaatataaagcaagtctaaacttaccactcgtcacaccaattatttcttgtgactgtgggttaaccaaggaaattgaagctttcaataacatttttctcccactatcaaacccccctttgacgtctaaaaaaaatttgctcaaaacaaataaaaactccgtttctaaaataaaatccagacagatggataattcgaaacctaggccaaggttgaaaacgaagttggatgcggatctacatgataccggatttttagacaatttcaaaacgcggaattcctgtgtaaagatagagaaagaagattctttaacgaacttaaacgaaattgattttacgaacatgttttgcaacgacaatttcatccaaaattacaaccaaggcctgatggaacttttgacagaacctacaccaggtccttcgtcctcttcttgtatacttccttcaacaccaacgaggcccttgtcacaaagcaaaatggatatagccctgtcagaatcaacaacatcttcaccaaattttatggaaacagacgctccttatggagatgagatcattaaagtttccaaagataccaaaagcaacgcaccaactgctgatacagatattgctacgaacttaggcaaagagagaaacgaaaattttggcatgttaaactacaactacgaagcgttgcttcatttcaacgatgagcattttaatgaattaaattctattgacccagccttaatatcaaaatattaa

SEQ ID NO: 4 - protein, 416 aa, Saccharomyces cerevisiae
MKAKSMKSIISVPISVSKTGKMKLTASPDNLASMMSKDQNKLIHLDPVPSFEDRHEIKPWLQKIFYPQGIDIVIERSDSSKVTFKCRSVRSKVGLNPKSKGSSSRSHACPFRIRAAYSVRLQKWNVVVMNNIHSHELRFDLITKTDDYKKFKENLRQKNDEKAIKTFDELEYKASLNLPLVTPIISCDCGLTKEIEAFNNIFLPLSNPPLTSKKNLLKTNKNSVSKIKSRQMDNSKPRPRLKTKLDADLHDTGFLDNFKTRNSCVKIEKEDSLTNLNEIDFTNMFCNDNFIQNYNQGLMELLTEPTPGPSSSSCILPSTPTRPLSQSKMDIALSESTTSSPNFMETDAPYGDEIIKVSKDTKSNAPTADTDIATNLGKERNENFGMLNYNYEALLHFNDEHFNELNSIDPALISKY

SEQ ID NO: 5 - DNA, 1608 bp, Candida glabrata
atggattccaaccaactaatacacttggattcggttcctaatttcaaggataagaatgagattaaaccatggttacagaaaattttctacccgcagggaatagagatcgtcattgagagatcagacagtcttaaagttgtatttaagtgtaaagctgccaagaggggcaggaagagtcaggaagaacttaccgaggaagaacgtttacggcaagaggctttggctagggaacatgaaatgaagaggaagtctatgggtaacaagaggtgtgtgtcgcgatataatcactgtccattccgagtacgggcaacttattcgctaaagaggaaaaaatggagtgtagtggtgttaaataatacacatacccatcctttaaaatttaatcctttatctgaggagtataagaaattcaaagagaaacttcgagccgataatgatgtcgatgccataaaaatgtttgatgaactagaatatcgaacgcaacataacttaccacttccaacatcgatcattccttgtgattgtggtctgactaatgaagtgaaaagctttgatgtggtattacccaaaactatggtaccagacgaattatcggttaaggctagcgaaatctcattaaagaaagtattggaagaagatgaaaactgtacattcttgacaaatctgaaaaaatccagtgcaatctcaaagaataaaggagtgaagcgattgaaacccaagcattcgctatctggcaatacagaaactttaagaaaaaatcttctttggaaaagtaatcaaatttactatagtgagactgctgtaaattcgccgatgttagattcttctccaaatttatttggaaatcaattatctttgtctacaccagatttggtggcagcagatgctggcagtaatggcagtcaaatatctaccaaagcctttagtgattttatagatgatccatttacagtgggtactaatggcaatggtgcagacttccaaccattcacagcttcaaatacagggaatgcaataaccaatttggacgagattgattttactaatatttttgccagatcgactaataacaaccacaagcacccttataactctacagctattgataggaatgattcaccaacatcaaatgctcctttatcagtaaaaaatgcctatgatggacttgatgattgttggtcaatatacatgtcaccaaacactacccatgatgacacacctgttgatatttcccctgcatcctctaaactacataacaagatgcctagaattccagagcaaaggtcagattctttacaaccgaatgttcggtttaatgatacagctttaaaacatgaaagtttattcacagatgacctcataaataagagtagtccaagacatgacgttggagatgaattcttgtttgataagatgctgaataaagaattgacgtctttgaacgaatttacagagaacaaacattctgactatcctgtaaacgcgggttcatttaatcttgatgtctttggaccttctgtcgataacaatgattctttgtccactttagattttactaagcctatgaacgataactttgttaaattagaagaagatcacataatgtga

SEQ ID NO: 6 - protein, 535 aa, Candida glabrata
MDSNQLIHLDSVPNFKDKNEIKPWLQKIFYPQGIEIVIERSDSLKVVFKCKAAKRGRKSQEELTEEERLRQEALAREHEMKRKSMGNKRCVSRYNHCPFRVRATYSLKRKKWSVVVLNNTHTHPLKFNPLSEEYKKFKEKLRADNDVDAIKMFDELEYRTQHNLPLPTSIIPCDCGLTNEVKSFDVVLPKTMVPDELSVKASEISLKKVLEEDENCTFLTNLKKSSAISKNKGVKRLKPKHSLSGNTETLRKNLLWKSNQIYYSETAVNSPMLDSSPNLFGNQLSLSTPDLVAADAGSNGSQISTKAFSDFIDDPFTVGTNGNGADFQPFTASNTGNAITNLDEIDFTNIFARSTNNNHKHPYNSTAIDRNDSPTSNAPLSVKNAYDGLDDCWSIYMSPNTTHDDTPVDISPASSKLHNKMPRIPEQRSDSLQPNVRFNDTALKHESLFTDDLINKSSPRHDVGDEFLFDKMLNKELTSLNEFTENKHSDYPVNAGSFNLDVFGPSVDNNDSLSTLDFTKPMNDNFVKLEEDHIM

SEQ ID NO: 7 - DNA, 1314 bp, Candida glabrata
atgaatcgtaagaacacgctcaggggttctgctaaaaacagacccacgaccacacctgataacttagaaaatgccttaatggtgaatgaaaaccaactgatacatatcgacccagtacctgactttcaagagaagatagatgttaaagtatggctacaagaaatgtttttccccatggggatagatattgtcatcgagaggtccgataaaacaaaaataatattcaaatgtaaacctagtgattacagaagccatgaaccaaaggacctacggcaaaaggaaccagttgacgataaaagacacatatgcccatttagggtgcggtgtactttctctacccaactaaagaaatggaagatcgtgataataaataactcgcactctcatccattgaaattcaacccacactcagatgaatatgctaagtttaaaagaaatctaagagatagagaaatgactgaaacgttgaaaaagtttgaagaactagagtataaagccaagtcaaatcttccgatggaaaatctgctatcaggaaactcaattatttcttgtgattgtggcctaacgaaggaaattaagacaatcaataacgtttacttgccactaaatgccactcaattacaggatgagatagatgtctcgaaaatactggagtgtcaaaataaaaaacaaaagaataaacaaaaggtaatgaagaaaagaaagagcgagaaaaacgaacttgctaacattaagaaagaggaacctagctgttcaagtgctttgattcatgacaaaggcttcgaaatcactcaagatgatctcatacaatgtggtatcaatgatattaacgattatgactgcgataaatactacacagagcttctgaacaaggaaagttacgcggatgcatcctattgtaacatcgcagatttttcgaacatgaacgaaattgattttactgggatgtttaacaaatcaaaaccagctcaacctagtctcactaaaggtgatgatctttttagttcaatagcaaatgataacttctttagttatgaagagaatatcaaggatacgacattggtagagccagaacttctaatggcgcctgtacaagacatcaacgaaaacaatatcgatgatatattcaagatgtccactaacacatcatctactccaatatcaccatctactgacccatcaactgatattgaccaaaaaatacccgaccctctcgagttcgagaatgtcaattatttagacaagtatgttgatctatcaaccgtaatgattaatgatcctgcgaaggaaacttacgactctctttttagttaa

SEQ ID NO: 8 - protein, 437 aa, Candida glabrata
MNRKNTLRGSAKNRPTTTPDNLENALMVNENQLIHIDPVPDFQEKIDVKVWLQEMFFPMGIDIVIERSDKTKIIFKCKPSDYRSHEPKDLRQKEPVDDKRHICPFRVRCTFSTQLKKWKIVIINNSHSHPLKFNPHSDEYAKFKRNLRDREMTETLKKFEELEYKAKSNLPMENLLSGNSIISCDCGLTKEIKTINNVYLPLNATQLQDEIDVSKILECQNKKQKNKQKVMKKRKSEKNELANIKKEEPSCSSALIHDKGFEITQDDLIQCGINDINDYDCDKYYTELLNKESYADASYCNIADFSNMNEIDFTGMFNKSKPAQPSLTKGDDLFSSIANDNFFSYEENIKDTTLVEPELLMAPVQDINENNIDDIFKMSTNTSSTPISPSTDPSTDIDQKIPDPLEFENVNYLDKYVDLSTVMINDPAKETYDSLFS

SEQ ID NO: 9 - DNA, 1677 bp, Zygosaccharomyces rouxii
atggatagtattagtaccagctctggtttagtccccgattcaatgacggagtcggcggaaagtcatagtagacagaccaacgatggaagtttagcgatacaagccaatgaattaccaaaggcattagcagaagatcaaaacaaatttattcatttagatccggtacctgattttagagacaaggcagaaattaaaccatggttacagaaaatcttttacccacaggggatagaaattgtgattgaaagatcagataatattaaagtcattttcaaatgtaaagccgcgaaaagaggtaaaaatacgaagcccaggcgaaatgaagtcacaactacaagttcaatgagtgcaagctcttcaagtgttactagtccaaatacaggattaagttcagcagcaggtaaaaagaaaagatcagtatcgagattcaatacatgtccatttagaatacgtgcaactttttcattaaagagaaggaaatggaacatagttgttgtaaacaattcacactctcacgaactaaaattcgatcctgatagtgatgaatatcgtaaatttaaggaaaaacttagggaggacaacgattgggatgctgtaaagcaatttgatgaactagaatataaatcaagatctaatttaccgattgaatcttcattgataccgtgtgaatgtggtcttaccagtgaaattgaaagttttagtatcgttttaccaagtacaaagccagctcaaaataataatagtactgatagccctagtactaatattactaatagaaatagcgtttcgagcattggcagtggaattgggagtaatagtagcggaatggcacctgtaattagtaaaccaagaagtaaaaagtggcagcagcagcaacaacaaaggcatagagaaaagttgatgagaaatccttccactgagcatcttttcacacaatcacaattacaattacaattacagcagttacaacagggttgtccagttgaatttttggacccttcaatatttacggattcatttgcatcttcgccagcatcttcaacgatggcaactcaaccgccacaacaacaacaacagcaacagcaacagcaacagcagcaacattcactccaattgactgatcctcttactgaatttaacgagattgattttacggatattttcaaaccacattcaattcacttacaagatgtacattcaaacactcaacaagatcatggatcggatcttttgcaaccatcacaatcaagtcctccacaatttttagataccaatcatgaaacggctagtagaagagatgaatttccaccacttttattttcaccgcttgatgcggctgcaaacgagcttatgaccccaacagatgatatgtccgtatcaccatcacatacatcaaattcacaaaataatagtagtcagcgatggccaactggcatttctattcatgatcaacaccaacaccaacaccaacaccaaccaattttacgacagtacttcaacgatgatgagattttagcgccagcaaggcttgcctcgttatggccacagcaacaagaaacgtcttcatcaagtccactgcgtagggtggttaatgctgtcgattctcaatcgccttgtaatgaaaatgactacgcagttgacgaccttctgtggaagatgaatttcgaaaacgcataa

SEQ ID NO: 10 - protein, 558 aa, Zygosaccharomyces rouxii
MDSISTSSGLVPDSMTESAESHSRQTNDGSLAIQANELPKALAEDQNKFIHLDPVPDFRDKAEIKPWLQKIFYPQGIEIVIERSDNIKVIFKCKAAKRGKNTKPRRNEVTTTSSMSASSSSVTSPNTGLSSAAGKKKRSVSRFNTCPFRIRATFSLKRRKWNIVVVNNSHSHELKFDPDSDEYRKFKEKLREDNDWDAVKQFDELEYKSRSNLPIESSLIPCECGLTSEIESFSIVLPSTKPAQNNNSTDSPSTNITNRNSVSSIGSGIGSNSSGMAPVISKPRSKKWQQQQQQRHREKLMRNPSTEHLFTQSQLQLQLQQLQQGCPVEFLDPSIFTDSFASSPASSTMATQPPQQQQQQQQQQQQQHSLQLTDPLTEFNEIDFTDIFKPHSIHLQDVHSNTQQDHGSDLLQPSQSSPPQFLDTNHETASRRDEFPPLLFSPLDAAANELMTPTDDMSVSPSHTSNSQNNSSQRWPTGISIHDQHQHQHQHQPILRQYFNDDEILAPARLASLWPQQQETSSSSPLRRVVNAVDSQSPCNENDYAVDDLLWKMNFENA

SEQ ID NO: 11 - DNA, 1359 bp, Ashbya gossypii
atggagtactcgcaggacgcatggggcaaacagtcgccgctggatgcgtcgccgtcggcgtggtcggtgtcggagacggcaggggacgtgccgagcggggcgtcggcgacgacggccagcgggcacaacgtggagggcagcggggcgcgcagcagcccctactcggaagcgagctacaataacgtgctgagcgaccaggccatcgagcggatccggcggcagcagaaccagaacaagctgatccacctggagcctatcccggacttcaaggacaaaaacgacatcaagccgtggctgcagaagatattttacccacagggcatcgagatagtgatcgagcggtccgacaagatcaaggtggtgttcaagtgcaaggcgtcgaagcggacgaagagcgggtccgcgccgggctcgcaggccggcgcggcggaggacgagctgggcgggcagtacgagacgctgccgctgtctccggtggtgacagcgtcgcagctgcgcaaaaagaagcgcgcggtgtcgccgtacaacacatgtccgttccgggtgcgagcggcgtactcgctcaagcgcaagcgatggagcatcgtggtggtcaacaacgggcactcgcacccgctgaagttcaacccggactcggcggagtaccgaaagttcaaaaataacctgcggcaggagtgcgactgggacgcggtcaagaagttcgatgagctggagtaccgcagcaagttcaacctgcccacggagccgacgccgataccctgtgactgcgggctgactcaggagatcgagtccttcaacgtcattctgcccagcaccaacatcctgggctcctccgcgcccgtcttcaccgagaagaagacggtctcgaagccgcgatgccgcaagacgctgcagcgcgaccgctgctcgcagctgcgacgccagagcacgcagtcgaagctcacgcacgagctgcacacggcgctcagtccgacgctggggtcgtcagccgacaccctcggctcgcccgtgcgctacgccgcgcaggacgcagaggtcgacttcacggaggtcttcctgcgctcgctgccgcccgcgaagccactgcactccgcgcgcgcgcccgacgccgcgcgcgacagctggcacgcgctcgagcagctgctcgacgaccccgcggacgcgccgccccgcacgccgctcccgtccgcgtccgcagactgcgtcaacccgctgctgcacttcgcgcagcgccccgcggacgatcccgtcgactcgctcgcctacgagctcaacgcgctcagcgccatggactctccgttcgcccgccccgcgcccgacgcccagtttctctgggaggaccccaagtatttcccctag

SEQ ID NO: 12 - protein, 452 aa, Ashbya gossypii
MEYSQDAWGKQSPLDASPSAWSVSETAGDVPSGASATTASGHNVEGSGARSSPYSEASYNNVLSDQAIERIRRQQNQNKLIHLEPIPDFKDKNDIKPWLQKIFYPQGIEIVIERSDKIKVVFKCKASKRTKSGSAPGSQAGAAEDELGGQYETLPLSPVVTASQLRKKKRAVSPYNTCPFRVRAAYSLKRKRWSIVVVNNGHSHPLKFNPDSAEYRKFKNNLRQECDWDAVKKFDELEYRSKFNLPTEPTPIPCDCGLTQEIESFNVILPSTNILGSSAPVFTEKKTVSKPRCRKTLQRDRCSQLRRQSTQSKLTHELHTALSPTLGSSADTLGSPVRYAAQDAEVDFTEVFLRSLPPAKPLHSARAPDAARDSWHALEQLLDDPADAPPRTPLPSASADCVNPLLHFAQRPADDPVDSLAYELNALSAMDSPFARPAPDAQFLWEDPKYFP

SEQ ID NO: 13 - DNA, 2472 bp, Kluyveromyces lactis
atgaagcacgagctacagacacctattgaaggagtggatcccttggatcctcttcataatccggatttatggcagccttctccatcttttgacaatatgatggcttcgccgaagacttcgcccatcggttctggactgtcccatacaccggcggctcaccatgttggctcgaatttatcctcgagtaataatagcgaagtctcttataacaatgcgttgagtgaaaacgcgatagaagctcttcggagacagcaagaccagaataaattgattcatttggatccgatccctgacttcaaagataagagtgaagttaaaccgtggttacagaagattttttatccacaggggattgagatcgtcattgaacggtcggatagcatgaagatcgtgttcaaatgtaaagctgttaaaaagaatagaaatacttcgtctatatccgggtgtggtcacagccacggcgttggtagcgatagttgtaacactaatgggaagaacagtactaagggtaatggtagtaatgataataagtgtaggaaaaagggaatcgggaagggttttgccgaatgtgatggtcttgaaacagagacagaaaacggtaataatagtaacagtactgtcggtggtggaaatggtagtaacgatacagacaagaagaaacgtgccatcggaccgtacaattcatgtcccttcagagtgcgagccacgttctctttgaagagaaagaagtggaacatcgtcgttgtcaataacgtacacacccatccgttgaagtttaaccccgatagtgaagattataaaaagtttaagaatgctctaaaggaaagcggagaccttgaaaccgttaaaaagttcgatgaattggagtacagaacaaggtttaacttgcccattgatcttagtcccatcccctgtgattgtggtcttactcaggaaattcaatccttcaatatcgttttgcctacaacaaatatcatcgtacctgggtcaaggaatacttccatggatgccaatacagtaacaaaaccaaagaagaccggtaaaaaagctgtcaagagtaagactacaaaacagctgagacgtaaaagcacaaagaaaaagttacaacaagatatagagagcaatagtgcaaacacttcgagaacagcaactccgctaagtactgtgcagaattcgttgaatttacagttcgattcccaatcaaatgtttcagtagctccatctgtgacttctaacctgaattcaaacttggccctaacgcctcaagagaatatttactcaactgatttcttgccgaatactgcttcttcgcaacagatggattcacctaacttctcaaacttcaactcgaactatttcaacgtgcaaaatgaaattgacttcacggagttcttcagtaaacctttgcctcacttcaaaaataatcgacatgatgtggttacaggccaaggcatgattccacttacattttcccagaaacaccaaacgagttctcaaagtgctcaacatacccctcaccaaaacatcaacagtaatctaatgtaccataatgctggttctgcatcttctacgcattcgtccccaaatatgagtataatgacgtctgtaaagactcccattacaacggctactcccagtacaaactctcacaatatgaacgcgatcagttctgtgccactttattcgtccaacttggccaaggagcctatacaagatttcattgacatgaaccaaatatttggtacttcaaccaataataatgaccattctaatgctaatacttcatccgttaatactaataataaccatcttcatcaacaacataatactagtcatgctaatgccatgataccttcgcattcactaaatttccaacattccaatctatcgccagtaaatcagaacattagtgcagtatgcgaaattaacaactttgacgtatgtgctaatgaccctcaatgtggtggtcctctcattggtactgctactggtattcatggactcaatatagatcgttcaaacatggagatcgctaatggtatcagccaatcaaacgatgcgacgggctacatggatcctctgcatacaaagccagattatgatgctcaatcacaggaatacatttctaatgtattaaactctgacttcaacgaactgcgattatcacaaagtcaacataatcaaggagagcaacaccatcaacaacatatgcagcagcaacgccgccaccagcatcagatgcaaaatcaacagcaacagcaaatgcaacagcaacagcaacagcaacaacttcatgatcagcacaaccctctacatgagattttacctttgaaagaggaagagattgaagagctcgttgcgaattcggagtacaattatcacctacagtttaataatgatcttgaccaaccgcagcaagctacgcataatccacaaatgctttgggatgaacctcacggcttttttcaatga

SEQ ID NO: 14 - protein, 823 aa, Kluyveromyces lactis
MKHELQTPIEGVDPLDPLHNPDLWQPSPSFDNMMASPKTSPIGSGLSHTPAAHHVGSNLSSSNNSEVSYNNALSENAIEALRRQQDQNKLIHLDPIPDFKDKSEVKPWLQKIFYPQGIEIVIERSDSMKIVFKCKAVKKNRNTSSISGCGHSHGVGSDSCNTNGKNSTKGNGSNDNKCRKKGIGKGFAECDGLETETENGNNSNSTVGGGNGSNDTDKKKRAIGPYNSCPFRVRATFSLKRKKWNIVVVNNVHTHPLKFNPDSEDYKKFKNALKESGDLETVKKFDELEYRTRFNLPIDLSPIPCDCGLTQEIQSFNIVLPTTNIIVPGSRNTSMDANTVTKPKKTGKKAVKSKTTKQLRRKSTKKKLQQDIESNSANTSRTATPLSTVQNSLNLQFDSQSNVSVAPSVTSNLNSNLALTPQENIYSTDFLPNTASSQQMDSPNFSNFNSNYFNVQNEIDFTEFFSKPLPHFKNNRHDVVTGQGMIPLTFSQKHQTSSQSAQHTPHQNINSNLMYHNAGSASSTHSSPNMSIMTSVKTPITTATPSTNSHNMNAISSVPLYSSNLAKEPIQDFIDMNQIFGTSTNNNDHSNANTSSVNTNNNHLHQQHNTSHANAMIPSHSLNFQHSNLSPVNQNISAVCEINNFDVCANDPQCGGPLIGTATGIHGLNIDRSNMEIANGISQSNDATGYMDPLHTKPDYDAQSQEYISNVLNSDFNELRLSQSQHNQGEQHHQQHMQQQRRHQHQMQNQQQQQMQQQQQQQQLHDQHNPLHEILPLKEEEIEELVANSEYNYHLQFNNDLDQPQQATHNPQMLWDEPHGFFQ

SEQ ID NO: 15 - DNA, 2100 bp, Vanderwaltozyma polyspora
atggtctcagaaaaagatattatatggaaccctatagttcctctctcagaacttaatcaagatgatacaataaatgaaaataatactactaaaaataataaaaatccaaaacctagcgatacttatattcatctagatccaataccagattttcaggatacctctgaagtcaagccctggttacaaaaaattttctatccacaaggtgtggagctcgttatcgaaagatcggataatacaaaagttgtcttcaaatgtaaagctgcaaaaagaggcaaaggttcaagattaccatctaaaacaacaacaactactaataataataacaatgatgatgaaaatgatgaaaatagcgaaaataaagagactaatagcaacgacgataaaaatagtaatgttataaatgatggatatttagataaaccaaagaaaaagagagtagtatcgagatttaatacctgtccattccgtataagagcaacttattcaatgaaaagaggaaaatggaatatcgtaatattaaacaataaacattctcatgatttatcgttcaatcccgattcaatagagtataagaaatttaaagaaagattaagattaaataatgatgtcgaagcaataaaaaaattcgatgaattggaatataaagtacgatcaaatctacctctgagcccttcgttagtggtttgtgattgtgggttaacaagtgaaattcaatcattcgatgtggttttaccaacaaatgactctttaaatacaaatatcgtcgatctatcaaataaaaatttagaaacaaatttcaaccaacagtctgtaaatgttaaaaaaccaaaaaaattgaaaaatgtaaagtcaaaagcaactaacttgaatatacatcaagaaaatttgttgaaaaagaccactacccaaaattttttaactaatcgcaatgcaaattctcaccctcagccaattccctcatcttcaccaataacttcaaataatattcattcaaatatgcattcctataatcatagtcatagtcatagtcatagtcatagtcattcacatactcatatgaatggtcatactcatacccataatcacacaacacctccagttgaatctctagatttgttgcagccagatactttcaattcattgactttctcaaagttaaccactgatttagatgaaatcgatttcactgatatattcaacaagcctctatataataaaaatcacaatcatcatcatcaccaccatcatcatcataattttgaggataataacaactataatgagtataatgataatgatataaactcccattcatctttatattcaccaattaccaatggaggaactcctaagatgttggaaagtgatacaatttcaccaaacccagacttatttccttctcaatacgaattacagcataattacagttattcaaataaccaaatttcatcacctttaaaagattcaccatcacattattcaaatatggattttacccattcttatctttccacaaataataactacaagaaatattcaattacattatgtgaaaataataacagtaatatttgttataacgatgaatgtatcaaactacacgatatacagccgatcaagaatgagttcataggcacacagtcgttgaattcactaaatgaacaagctaaaggtgaatatgatccaatgcatttaattcagaaatttatgaatacatctaacgatgataatgtcattaaaagtgcaaccaccggaaacgcggttttaataaaaaatgagttagatttaacgtctgtaccattgacatttgacagtgaaggtaatcatataactttagataacatttcatctagtcaacctaaaaggaaacaaaatgaatcgggtaattcaaatctctctgatctttcaactctaatacctaacaatcaagaagcattcccacaagttataagtgatatagacataactaattacaattttgaaagtattaacactactaataaagccattaatggtaacactaacacttcaatccaagatgataaaggctcattatcgccctcaatttgggagaacacattcgatgatattttgtaa

SEQ ID NO: 16 - protein, 699 aa, Vanderwaltozyma polyspora
MVSEKDIIWNPIVPLSELNQDDTINENNTTKNNKNPKPSDTYIHLDPIPDFQDTSEVKPWLQKIFYPQGVELVIERSDNTKVVFKCKAAKRGKGSRLPSKTTTTTNNNNNDDENDENSENKETNSNDDKNSNVINDGYLDKPKKKRVVSRFNTCPFRIRATYSMKRGKWNIVILNNKHSHDLSFNPDSIEYKKFKERLRLNNDVEAIKKFDELEYKVRSNLPLSPSLVVCDCGLTSEIQSFDVVLPTNDSLNTNIVDLSNKNLETNFNQQSVNVKKPKKLKNVKSKATNLNIHQENLLKKTTTQNFLTNRNANSHPQPIPSSSPITSNNIHSNMHSYNHSHSHSHSHSHSHTHMNGHTHTHNHTTPPVESLDLLQPDTFNSLTFSKLTTDLDEIDFTDIFNKPLYNKNHNHHHHHHHHHNFEDNNNYNEYNDNDINSHSSLYSPITNGGTPKMLESDTISPNPDLFPSQYELQHNYSYSNNQISSPLKDSPSHYSNMDFTHSYLSTNNNYKKYSITLCENNNSNICYNDECIKLHDIQPIKNEFIGTQSLNSLNEQAKGEYDPMHLIQKFMNTSNDDNVIKSATTGNAVLIKNELDLTSVPLTFDSEGNHITLDNISSSQPKRKQNESGNSNLSDLSTLIPNNQEAFPQVISDIDITNYNFESINTTNKAINGNTNTSIQDDKGSLSPSIWENTFDDIL

SEQ ID NO: 17 - DNA, 1563 bp, Lachancea thermotolerans
atggatcagtcagcattagacgcgttccatggagaactaatacagacgtcgccgtcactggactttctactggcggaggactcgccgctctcgacagtagatacagtgggaacaggcacgacgagcaacacagagagcagcgggccagatttcacaaacggcacccctagctggaatgacacggccagtctgaataacatgctgagtgaaaacgcgcttgagtccatcaaccggcagcgatcgcagaacaagctgattcacttggatcccatacccgatttccaggatcgtaacgaaatcaagccgtggcttcagaagattttctatccccaaggtatcgagattgtgatcgagcgttctgacaacatcaaggtagtgttcaagtgcaaggcgtcgaaaaggggcagggcctctcgcaagcaagccggttgcgggtcgctgccggaagaaaaggaaaaccccgagagcccgctggcggtgaagagggtacaacaggcaaacaagaaaaagaggtccgtatctccgtataacacatgcccgttccgggtacgcgcgacatattcgctgaagcgcaagaagtggaacatcgtggttatgaataatggacactcacatcctttgaagttcaacgccgatagcgacgactacaaaaagttcaaaaattacctgcgtgagaatgaagactgggacgccgttaagaagttcgatgagctggagtgcaggactcgtttcaaccttcctacacaaccacaaccgatcccctgtgactgtggacttacgcaagaaattgagagttttaacattgtccttcctacgtcggactctctcgcaaattcaaccgacaagacagtgagcaagccacgccacaaatccacgcgcaagggcaataagcagatggccacggctctcagtcgaaattcaacgcctctcggatttttggacaagtcaccgtctcaatcggcacgctctggacaagagccacagcgtatcaagcaggagagcaccggcgccccccaggaacctcattctggcatgacggggttatcgccgatgcaaaactttgatacatctatgtcaggatgggacccaaacacgctcaccagccagtccgaggagattgactttacagacttgtttcttcgacctttgcctcggacaaagcaggaccccatttttgagaagccccaaacgcttaacagtcccgggcgcgaccagccttggaacgcttccaaaaacttcatggacgacctgcaatttcaactcgcgccggtatgcgaacccagccacacaagcaatgcccactgcattcttccgtcatcgacagaggcacatatgaactgcgatgcaatggacgctggctcacagcatgagtttccccatcacagggtccaacagcaagacccaagcatgctgcatagctccccggctaacggaatgctgagctcggaccttggcaacatgcacctcacgggtcagcagatgcaagtgccgcatcctgacccaggactcccctgggaaccacaacacagcaacgaccctcatggatatagtaatgacttctag

SEQ ID NO: 18 - protein, 520 aa, Lachancea thermotolerans
MDQSALDAFHGELIQTSPSLDFLLAEDSPLSTVDTVGTGTTSNTESSGPDFTNGTPSWNDTASLNNMLSENALESINRQRSQNKLIHLDPIPDFQDRNEIKPWLQKIFYPQGIEIVIERSDNIKVVFKCKASKRGRASRKQAGCGSLPEEKENPESPLAVKRVQQANKKKRSVSPYNTCPFRVRATYSLKRKKWNIVVMNNGHSHPLKFNADSDDYKKFKNYLRENEDWDAVKKFDELECRTRFNLPTQPQPIPCDCGLTQEIESFNIVLPTSDSLANSTDKTVSKPRHKSTRKGNKQMATALSRNSTPLGFLDKSPSQSARSGQEPQRIKQESTGAPQEPHSGMTGLSPMQNFDTSMSGWDPNTLTSQSEEIDFTDLFLRPLPRTKQDPIFEKPQTLNSPGRDQPWNASKNFMDDLQFQLAPVCEPSHTSNAHCILPSSTEAHMNCDAMDAGSQHEFPHHRVQQQDPSMLHSSPANGMLSSDLGNMHLTGQQMQVPHPDPGLPWEPQHSNDPHGYSNDF

SEQ ID NO: 19 - DNA, 1818 bp, Debaromyces hanseii
atgactgtctcaattaatttacagcattcattaagtgacctaggtctcgattcacaacgatttacaaacaaggatgatataaaaccttggttacaaaactatctattgcataagaaaggaatccatgttgtaattgcaagatcagatgcaaataagattgtatttagatgtaagtcagataagagcaaagagacagcagagaaattaagtttaggttctagacgccaaatctcatgcccattcaagatacgagctaactactctataagaaaccatgtgtggactttggttgttatgaatgaaaatcatgatcatgaattagataattttggtttaatgcagcaaagtaagcttgcgtatttgtttaaccaccataaaactaatgaatccggactcctttcactgggatccgatgattctacatctgcagcattaacaaatccttcgaaaagtaatacatcttcggacgtattcagctcatttattccatcatcaacggaaatggtttcaccaaatgaagcacatgataaccataacctagctctgtcgattgatgagttgaaggatacggtcacgtctaaagataatagcgatagtgaaaaaatgcttgacacctatgaggaacaaaaaagtaagaagaggaaagtacctaaaggacataatgttaaaaggagaaagactaaaagagagactatctcagtccatgatgaagaccaagaatcccgacaagataaatcgagcaaagaggtagtcggtgatcttagagagcaagttaatttattaatttcgaacacaattattaacaaccaaaacttcaccgataaggaaaagtcaatgatgattaaatcgtttttttcacgctttataaaagactataaaggtattatcaataccgtagcaaatcaacaaaaaatggtactcaacaattggtttaacacccctaatcctgctcaaactaacttacattcccatgcaaacactaatttaattccactatctcccttattaaacgatacagatacagattatacaagtgctaccccaaataatagcaataaccagtcgatagataatttgacacatcttccaaatatgtcgttgggatcatctctaataacaaatgttggagctgcatgtaatagtacaggtccatcaaattccaatgcaaacaataattataacaattttattgttccgccgcaaatgcagttgctgcaaattcaaaaccaaaatcaacaattaccttcattcaacactattcagaaccagcttccgctttcacctaattcgctagcaaataactccaccgcttcattgtttgtgaataatttcaatacgaacttaaattcaaacacgtcatcattaatcccacctataaacaattccaataccaatacaaccctcaacccgtcccacctattaaagtcatccaataagaataatgtattcaataataacatgaacctgacagcatctagtaacttacttagtcgaaacgaattcaaacaaaacagttcattaaacccaattaacaataacatagccctgtcaaacacaataagcttaaatacaaatcaaaattctggctcaatatctaactccaatacactgaataattatactgttaattatggtggtttatcatcgccaaataataatatcattaacccaaatatccagaataattcgaccaacggagcattttataacaaagaaatgcaatctggaaatacaagtaacaatccacaaaattctacaacatcgaatacttctggtgctcttaatcatattgcaagcttgaatgataatggatggtag

SEQ ID NO: 20 - protein, 605 aa, Debaromyces hanseii
MTVSINLQHSLSDLGLDSQRFTNKDDIKPWLQNYLLHKKGIHVVIARSDANKIVFRCKSDKSKETAEKLSLGSRRQISCPFKIRANYSIRNHVWTLVVMNENHDHELDNFGLMQQSKLAYLFNHHKTNESGLLSSGSDDSTSAALTNPSKSNTSSDVFSSFIPSSTEMVSPNEAHDNHNLASSIDELKDTVTSKDNSDSEKMLDTYEEQKSKKRKVPKGHNVKRRKTKRETISVHDEDQESRQDKSSKEVVGDLREQVNLLISNTIINNQNFTDKEKSMMIKSFFSRFIKDYKGIINTVANQQKMVLNNWFNTPNPAQTNLHSHANTNLIPLSPLLNDTDTDYTSATPNNSNNQSIDNLTHLPNMSLGSSLITNVGAACNSTGPSNSNANNNYNNFIVPPQMQLSQIQNQNQQLPSFNTIQNQLPLSPNSLANNSTASLFVNNFNTNLNSNTSSLIPPINNSNTNTTLNPSHLLKSSNKNNVFNNNMNSTASSNLLSRNEFKQNSSLNPINNNIASSNTISLNTNQNSGSISNSNTSNNYTVNYGGLSSPNNNIINPNIQNNSTNGAFYNKEMQSGNTSNNPQNSTTSNTSGALNHIASLNDNGW

SEQ ID NO: 21 - DNA, 2082 bp, Saccharomyces bayanus
atggagggattcaacccgggccacatagaacacctgtctcccattgactccactgacaataatacggcctccttcgtatatccgctgcccaaagctaccggtgagtttgtgaacaatcacaacgaaaatcacagagatgtagatccacccgctgtgccgtcttccatggtgtctctaaattttaaggatccgtcctccccaaatggcgatttccatattcatacatctgcatcccccacggaatctgcagaacatggtcatcaatcagaaaagctgaatcagaataatttggttcatctagatccagtgcccaactttaaagataaagccgacatcaagccttggttacaaaaaatcttctatcctcaaggtatagagcttgtgatagaaagatcggatacctttaaagttgttttcaaatgcaaagctgccaaaaggggaagaaacacaaggaggaaaagaaaggataagtctaacgaacaggaccaagaagaggataagctgcaggtcaatgacgacgaattcgaaaatacaagtagttccaactttatagcatcgagtaatggtgctcgatcgtcacccgaactaacgtcttccgggaagccaaagaagaagaggtgtgtctcaaggttcaataactgccccttcagagtacgagccacttattcattgaagaggaaaagatggagtattgtagtaatgaatagcaatcattcacatccgctaaagttcaaccctgattctgaagaatacaaaaaatttaaagaaaaattaaggaaggacaatgatctggatgcgatcaagaaatttgatgagctagaatatagaacgttggccaatttacccattccgacagctacaataccttgcgactgtggtctaacaaatgaaatccaaagttttaacgttgttttgcctactaacagcaagtcatcctcgtctgcatcatcttcaagtgtatcgtcagtgtctctcgatccttcgagtgcctccaaaagaccatgcttaccccctgtaaataacattggtaatatcaatactaacaatataaggaaaccaagaagccaatccaagaataaagatacactcttgaaaagaacgaccatgcaaaatttcctcactacgaagtccagactacataagacgggcaccccaacatcttcacagcattcatctacagcattttctggatatattgacgatccattcaatttgaacgaaatattaccactaccgacatccgattttaagccaaatactgttaccaatttaaatgagatcgattttacaaacatattcactaaaccgtcacatcctcatagtgggaccactcatccacgacaggtctttgaccaattggatgattgttcctcgatactcttttctccattaactacaaacacaaataatgaatttgaagtagagtcggatgatttcgttcattctccatatttgaattcggaaggcgatttcagccaaattctcaataatgcttcccctgctcatcatattccagatcacacgcatttggaaaatcaagatattattgataggtttgccaatagttcgcaagagcagaacgagtacatcttgcaatatttgacacacttcgatgccgcaaacaatgccgccaatacttcgaacgatatttcacattcattaaacatccaccataatattactgacctgagcaactcacttctcaaacaggaaactttgatagataacccttcgactagaatctttgacgagttaaagttcatacaacataacccacacggtgctcaccaccctgtagaatttcaacatgaaaaccataatcatctaatgtcgaatgaacctcaaatacgacaccagcaatatgggccgcagcagcagcagcaacaacaacaacaacaacaacaacatgaatacccccatagtcacgaccaccacgatcatcatcacaaccagcatgaagaagtacgaaaagaggtacaagcacacgaaacacttgaaataatgggaaatacactattggaggaattcaatgacattaagatggtcaatggcgaattgaaatacgtgaaacgagaagattaa

SEQ ID NO: 22 - protein, 693 aa, Saccharomyces bayanus
MEGFNPGHIEHLSPIDSTDNNTASFVYPLPKATGEFVNNHNENHRDVDPPAVPSSMVSLNFKDPSSPNGDFHIHTSASPTESAEHGHQSEKLNQNNLVHLDPVPNFKDKADIKPWLQKIFYPQGIELVIERSDTFKVVFKCKAAKRGRNTRRKRKDKSNEQDQEEDKLQVNDDEFENTSSSNFIASSNGARSSPELTSSGKPKKKRCVSRFNNCPFRVRATYSLKRKRWSIVVMNSNHSHPLKFNPDSEEYKKFKEKLRKDNDLDAIKKFDELEYRTLANLPIPTATIPCDCGLTNEIQSFNVVLPTNSKSSSSASSSSVSSVSLDPSSASKRPCLPPVNNIGNINTNNIRKPRSQSKNKDTLLKRTTMQNFLTTKSRLHKTGTPTSSQHSSTAFSGYIDDPFNLNEILPLPTSDFKPNTVTNLNEIDFTNIFTKPSHPHSGTTHPRQVFDQLDDCSSILFSPLTTNTNNEFEVESDDFVHSPYLNSEGDFSQILNNASPAHHIPDHTHLENQDIIDRFANSSQEQNEYILQYLTHFDAANNAANTSNDISHSLNIHHNITDLSNSLLKQETLIDNPSTRIFDELKFIQHNPHGAHHPVEFQHENHNHLMSNEPQIRHQQYGPQQQQQQQQQQQQHEYPHSHDHHDHHHNQHEEVRKEVQAHETLEIMGNTLLEEFNDIKMVNGELKYVKRED

SEQ ID NO: 23 - DNA, 2013 bp, Saccharomyces castelli
atgagtcgacagaataacaattgcattgacccgacaacgacggacgccatgctggaggaaacctcatccgtctcatctgcttcttcaacaacaacgtcgccctcatcatcgtcctcctccacatcagtgggaaaccactgctcgccatccatcctcaagaaccatccggatgcatccgcaactgctgcccccaatacagataagatacaattgaatctaatgttccccagtaatcaaacatactctctagtgatgggcccggagaccaaacaaccgagaacgtccaaacagaaacaaaatgcaccaccgccagcacaaacagaggataactcggtcacattcgcaccagataatattcagatcgcattgaatcaagaccaaaataccttgattcatttggatccagtgcccaattttaacgataaggcagatattaaaccttggttacagaagatattctacccgcaaggtattgaaatcgtcattgaaagatcggataatacaaaagtaatctttaaatgtaaagctgcaaagaagggaagaagttccaataaggataagaatcaagcttctgcctcggatcccaccgtgacaacgccgaatgttaatcatgtcttgttgaagaagaagaagaaaagatccgtttctaggttcaatatttgtccctttagaattagagcaacgtattcattaaagaggaagaagtggaatatcgtcgtcataaataacacacattctcatccattgaaatttaacccggattctgaggagtataagaagtttaaattgaaattgagggaagacggtgatttggaagccattaaaaaatttgatgaattggaatataagacaaggaaaaatctgcccattcaatcatctatgatcccctgtgattgtgggttaactaacgaaattcaaagttttaacatagtcttaccttcgggaagaactgccgctaatagtaatgataccgcaacagcaacatctagtcgtccgattaaaaaattgttaagtgcaaacttaatttcaacaagcaatggtggcaacaacaataacgtgcaaaaaccaagaactagggtaaatgataagagaaataaggaaaatcttttgaaaaagacaaccacaacaaatttcttaactaataacggcacagcaccagccataccgactaatagggttaacagcctggtggaaaattcaaattcaatgacagatttcttagatgacccatttaattcctccatgaatattcccatgaacgattttgcaccatttaatttggaagcagtaactaatcttaatgaaattgattttaccgatattttcaataaaccaacaactttacaacaagatgatggaccattttcaacacttaacgaaatgcatattcacgaccaacaaacaccatatgctgcagatatgtctattttttcatcattagatactgccagtttaacaagattccaatctccaatgcatgatgtgaatgattcaccactacttcgaaatccatccaacacaacaaactcagaaatgttagattatatgtcaaatcaacatacaacgcaggaaaacaacgtgatacccaataatggtaataacaataacaacactacattggcaaacgaactggatgttttcaaaatggtggatggtgaattgaaaattatagaagatgataacgctttattaaagattaattcaacgacaggaaggcatgataatccagaaatgactaatacttccaatgaacataatccatacatgttccatgcatcccccgctgttcaagctgaaggacaattttggcaaaataatattaccaacaacgactcgataaacattacatcatccatgaatcagataactgacaatacaacaaacactaattcaaacatacaatccatcaatatgcaactcatagagttgaataatacttcgaaaaagtacgatgaccacaacaacaacaacaataacaacatcaacagccataatcataataatagtaattag

SEQ ID NO: 24 - protein, 670 aa, Saccharomyces castelli
MSRQNNNCIDPTTTDAMLEETSSVSSASSTTTSPSSSSSSTSVGNHCSPSILKNHPDASATAAPNTDKIQLNLMFPSNQTYSLVMGPETKQPRTSKQKQNAPPPAQTEDNSVTFAPDNIQIALNQDQNTLIHLDPVPNFNDKADIKPWLQKIFYPQGIEIVIERSDNTKVIFKCKAAKKGRSSNKDKNQASASDPTVTTPNVNHVLLKKKKKRSVSRFNICPFRIRATYSLKRKKWNIVVINNTHSHPLKFNPDSEEYKKFKLKLREDGDLEAIKKFDELEYKTRKNLPIQSSMIPCDCGLTNEIQSFNIVLPSGRTAANSNDTATATSSRPIKKLLSANLISTSNGGNNNNVQKPRTRVNDKRNKENLLKKTTTTNFLTNNGTAPAIPTNRVNSLVENSNSMTDFLDDPFNSSMNIPMNDFAPFNLEAVTNLNEIDFTDIFNKPTTLQQDDGPFSTLNEMHIHDQQTPYAADMSIFSSLDTASLTRFQSPMHDVNDSPLLRNPSNTTNSEMLDYMSNQHTTQENNVIPNNGNNNNNTTLANELDVFKMVDGELKIIEDDNALLKINSTTGRHDNPEMTNTSNEHNPYMFHASPAVQAEGQFWQNNITNNDSINITSSMNQITDNTTNTNSNIQSINMQLIELNNTSKKYDDHNNNNNNNINSHNHNNSN

SEQ ID NO: 25 - DNA, 1557 bp, Kluyveromyces waltii
atggatccgtcaccgatggatgcgttccagggcgaactactacagacatcaccgtcgctagattatctgctggcagaagattctcccttgtcgacagtcgatactattgggacaggggttacgagtaatacggaaagcagcggcaccgatataacgaacggcacacctggatggggcgagacagtgaatctcgaaaacctaatgagcgaaaaagcgctggagtccatcggcatgcaacgctcccagaacaagctgattcacttggacccgataccgaacttccaggaccgcaacgaaataaagccgtggcttcaaaagatcttctacccacaaggtatcgaaatagtgattgagcgttctgacaatatcaaggttgttttcaaatgcaaggcctcaaggcgaggcaagacatcccggaggcgaaatggatacggtcccattgcggaagaaaaggagaacccggaaaaccctctggcggtacaaagggtacagcagcaatcgtgcaagaagaagagatctgtttcaccatacaacacatgcccgttcagggtgcgagcgacttactcgctcaagcggaagaagtggaacattgttgtgatgaacaatggacactcgcacccgcttaaatttaatgccgacagtgatgactacaaaaagtttaaaaattatttgcgagagcacgaagactgggaggcggtcaaaaaattcgatgagttagagtgcagaacacgtttcaatttaccaactgagccccagcctataccgtgtgactgtgggctgactcaggagattgaaagtttcaatattgtactccctacgtccgattccatggccaactcaactgataaaacggtaagtaagccgcgtcataagtcgtcgcgaaagagcaatagccacattgccacggccttgagccgacatccgacaccactagaggtcctaggtagatcttcaccacaattggcacaagcaggaactgagcctcagtccatcaaagtggaaacccccacgcacaattcggaatcgaacgtgatgggtatgcagtcagtacaagcctttgatgcatccctatcggccctcgacgcatctctgtcaacatgggaacctaacgcccttcctaatcaatcagaggagattgactttacagatttattcctcaatcctttaacacgcatgaaacatgagccgatgaccggctcctcgcgggaattaccatggactgcgacaactaagcagttcatggatgaatttcaattcccactgtcaccagcacccgtatgtgaaatcaatcacaccgaccattgcaactgccttatgccatcatctacggatggactcgggcgagattcgccgcatgactttcatcaacgcattcaacaacaaggccgtatggaatctcgcagctctccagctggcgcggtcctaactgcagacctaaataacttgcatctcacgggccagcagcatatgcaaacgtcaaacctggatcagggtgtggcatggaaccaccaacacagtgacgaccctcatgaatatagtaatgattttttgccttaa

SEQ ID NO: 26 - protein, 518 aa, Kluyveromyces waltii
MDPSPMDAFQGELLQTSPSLDYLLAEDSPLSTVDTIGTGVTSNTESSGTDITNGTPGWGETVNLENLMSEKALESIGMQRSQNKLIHLDPIPNFQDRNEIKPWLQKIFYPQGIEIVIERSDNIKVVFKCKASRRGKTSRRRNGYGPIAEEKENPENPLAVQRVQQQSCKKKRSVSPYNTCPFRVRATYSLKRKKWNIVVMNNGHSHPLKFNADSDDYKKFKNYLREHEDWEAVKKFDELECRTRFNLPTEPQPIPCDCGLTQEIESFNIVLPTSDSMANSTDKTVSKPRHKSSRKSNSHIATALSRHPTPLEVLGRSSPQLAQAGTEPQSIKVETPTHNSESNVMGMQSVQAFDASLSALDASLSTWEPNALPNQSEEIDFTDLFLNPLTRMKHEPMTGSSRELPWTATTKQFMDEFQFPLSPAPVCEINHTDHCNCLMPSSTDGLGRDSPHDFHQRIQQQGRMESRSSPAGAVLTADLNNLHLTGQQHMQTSNLDQGVAWNHQHSDDPHEYSNDFLP

SEQ ID NO: 27 - DNA, 1911 bp, Saccharomyces kluyveri
atgaatcacttcgtagacaactctcctatggatccactgccaaatgatatatgggaacaatctccatcgttggagtccatgctaatgtctccttccgtttcttccagctcgacgaccaataaccaggcttgcacgccgactgggcttacaatcagcagcaacgaaacaacgatgagcaatgccagctataaccatgccttgagtgaaaacgctatagagtcggtaaagcgccaacaaaatcagaacaagctcatccacttggaccctatccctgattttaatgacaaaaacgagattaaaccctggttacagaaaatcttttatccccagggcatagagattgtcatcgagagatcagacaatatcaagattattttcaaatgcaaagcatcgaaaagaggtaagaaaaccagaaagtctgccttctgcggcccagatgatcctgggaacgaagatgaaaagagcctgcttgtacagagtctgacgaatagtaataacaacagcacctcgtcatccaatagcacaaagaaaaaaagatcggtctctccttacaatacatgcccatttaggattagagccacattttctctaaaaagacagaagtggaatatcgtcgtaataaacaatggccattctcatcctttgaaatttaacccggaaagtgaagactataagaaattcaaaaacaagctgagggaagatggcgattgggatgctgtaaagaaatttgacgagttggagtatagaacaaagtttaacttacccactgaaccgacgcctatatcttgtgattgtgggctgactcaagagatagaaagtttcaatgtcattttaccaagtgtaaacgcccaactcccttctctcccctcacaaaatgcatgtactgctaattcaaccgacaagaccgtggccaaacccaaaaaaaatcttgcaaagaagagcaggaagtctattactgccactggtagtagtggcagtatcaacactagatcattcaagaggaagagcacaaaggatttactgacacacgacatacaaagcaataagagtacatctacaacgagaactactacaccaatgaacgcatccctacagaacccctttacaagtacgagttttattgacggaaacgaaatcgattttacagaatttttgaaaccgttgcctcacttcaagcatttgcacggccaagccgacaccggcaacagcgttctcccgacccatcattcaaataattggtcacagcctgctccagcacaacaatggtcattaaataatctggtatcttcaccggttacacaaacagtgcatccccaaggcccgatagactttatgatgtttaatcagcaccaatcaatttcaccagacctccaaagcccagtgcatatgacgagttcgggtaatatacacacacaaacccactcacataccccgtctttgcagaatttacctgactttatgtcctttatctcggagcaccaacaaccactaaattttcagcatgtcccacagcatcagcaacaactacaacagcacaaaaatgtcagtatcgatgacttggatagaacaagcgtttcagtgacgactaccccaatgtgtgaagtaaataatagccatacttgtcaaagcgattgcatggaattaaaatccaccaacgcagtaaatgcacagcacaatttgtctcacaacttaacacaggtcgtcgatactcaaaatcaagcccaagatcaaaacactttgattggcagtgtgctgaatacagaacttagcaacatgagaatcattgatggtcagttacacgttgtagaagaagaaagaagtactgtggagccagagaatctgacgaaaaatacgagcgatcaacagtccaatttatttccatgggatggaacacagggcttctttggttaa

SEQ ID NO: 28 - protein, 636 aa, Saccharomyces kluyveri
MNHFVDNSPMDPLPNDIWEQSPSLESMLMSPSVSSSSTTNNQACTPTGLTISSNETTMSNASYNHALSENAIESVKRQQNQNKLIHLDPIPDFNDKNEIKPWLQKIFYPQGIEIVIERSDNIKIIFKCKASKRGKKTRKSAFCGPDDPGNEDEKSLLVQSLTNSNNNSTSSSNSTKKKRSVSPYNTCPFRIRATFSLKRQKWNIVVINNGHSHPLKFNPESEDYKKFKNKLREDGDWDAVKKFDELEYRTKFNLPTEPTPISCDCGLTQEIESFNVILPSVNAQLPSLPSQNACTANSTDKTVAKPKKNLAKKSRKSITATGSSGSINTRSFKRKSTKDLLTHDIQSNKSTSTTRTTTPMNASLQNPFTSTSFIDGNEIDFTEFLKPLPHFKHLHGQADTGNSVLPTHHSNNWSQPAPAQQWSLNNLVSSPVTQTVHPQGPIDFMMFNQHQSISPDLQSPVHMTSSGNIHTQTHSHTPSLQNLPDFMSFISEHQQPLNFQHVPQHQQQLQQHKNVSIDDLDRTSVSVTTTPMCEVNNSHTCQSDCMELKSTNAVNAQHNLSHNLTQVVDTQNQAQDQNTLIGSVLNTELSNMRIIDGQLHVVEEERSTVEPENLTKNTSDQQSNLFPWDGTQGFFG

SEQ ID NO: 29 - DNA, 2310 bp, Kluyveromyces marxianus
atggcgattaagcaagagatgggtgcgtctagcggtttggacccgctggaccctctggacccgctttcgaatgcggagttttggcacgcatctccttcttttgagatgatgaattcgccgaaggtgtcacctgcgagcactgtgatgacgcatacgcctagtgtgggcgggcagcagagtagcaacagcgaggtttcgtacaataatgttctgagtgagaatgcgatagaggcattgcagaagcaacaggaccagaacaagttgatccacttggacccgattcctgacttcaaggacaagagcgaggtgaagccgtggctccagaagatattttatccgcaggggatcgagattgtgattgagcggtcggacagcatgaagattgtgttcaagtgcaaggctgtgaagaaggcgaggagcggggttgcggctgcggcggccgcggcgtcttcgggttctggggtagcggggagttccggccacttcctagggtgtgcgtacgtgggcatgaacacgaatccgatgttgaataagggttcgagtaagaagaaggatggcagcggtaataatgccaggtgcaaggacgagaagtgcggcggcgatgggtcgtgtgaaaatagcggcgctaacgtcgacgctaatgctgcggaaaatgctaatgctagtaatagtaccacatccacgggcaaaaagaagagggtcactggtccatacaactcgtgtcccttcagagtgcgagctactttctcgttgaaaaggaagaagtggaacatcgtggtgattaacaacgtgcacacccacccgctacggttcaatcccgacagcgaggactacaaaaaatttaaaaagggtctatacgacagcggcgatatcgagacggtcaagaaattcgacgagctcgaatacagaactaaatcgaacctgcctatcgatttgagccctatcccatgtgactgtggtctaacacaggaaatccagtcctttaatatcgtccttccaacaacaaacattatagcatcaaccagcagagctggttcttctgatgcaaacactgtgtcaaagccaaagaagtgtaaaaactctttgaagaagaaatcaaaaaaattgaggctaaagaatacaaaacaaaagttgcaacaggatatcgaaagcaacagcgctcatacttccgctacaggaacgccattaggaaatgtaccaaatacactgaacctccaatttgacgtcaacatggacttgggtgtacagtccacttctggatcaaatatgaattcaagcgtggtattaacccctcaagaaaacatatattcgcatgatttcttccccaacacagcttcatcgcaacgtaatgactcaccaaacttttcaaatctaaacccaagctactttaacactgagaatgaaattgacttcacggagctatttagcaaaccattacctcatttcaaaaacaatcagcaacctgtaccccaatcacaggatgctattccactctcgttttctcataaaccatcaaacagtggtattccggacacccatcattctcaggcccaaggcaggcatatgttataccagaacgttgattctacaccatctactcattcatcacctagtatgaatgtaatgaccacaggaaagaattctatgacaatcacaccagctcttaacacagctacagcagcaacaggacccactcagagttccgtgccattgtactcatcggatatatctaaggaacaaattcaagatttcgttgacatgaatcaaattttcggcacctccgaatattctaaagaccgtaattctaactcaaataccccgaactctgtgatcccaggacggtcattaaactttcaacattctagattaccaacttcaaatcaacatcagaatcaaagtgctatttgtgaaataaataactatgatgtctgtgcaaatgactttggacaatgtggcggtgtcggcgctggtgtcgaaaccaattcacatagtaatactaacagtattactttgacgactagttctatgggtaatggtatcaactcgagcgtccatggttatgatattccaattaaaacagagttaacttcaaacccacaggagtatatctctaatgtactgaatacggattttaacgaacttaaactttcccaagatgaacaacatcagcaacaaggtggcatgaacaacctcggttctcaatcaaattacaactaccagttaatgttcgatgaggagttaaatcaacctcaacaaacaacgcataaccctcacaccctgtgggaagaacctcatggattccttcagtga

SEQ ID NO: 30 - protein, 769 aa, Kluyveromyces marxianus
MAIKQEMGASSGLDPLDPLDPLSNAEFWHASPSFEMMNSPKVSPASTVMTHTPSVGGQQSSNSEVSYNNVLSENAIEALQKQQDQNKLIHLDPIPDFKDKSEVKPWLQKIFYPQGIEIVIERSDSMKIVFKCKAVKKARSGVAAAAAAASSGSGVAGSSGHFLGCAYVGMNTNPMLNKGSSKKKDGSGNNARCKDEKCGGDGSCENSGANVDANAAENANASNSTTSTGKKKRVTGPYNSCPFRVRATFSLKRKKWNIVVINNVHTHPLRFNPDSEDYKKFKKGLYDSGDIETVKKFDELEYRTKSNLPIDLSPIPCDCGLTQEIQSFNIVLPTTNIIASTSRAGSSDANTVSKPKKCKNSLKKKSKKLRLKNTKQKLQQDIESNSAHTSATGTPLGNVPNTLNLQFDVNMDLGVQSTSGSNMNSSVVLTPQENIYSHDFFPNTASSQRNDSPNFSNLNPSYFNTENEIDFTELFSKPLPHFKNNQQPVPQSQDAIPLSFSHKPSNSGIPDTHHSQAQGRHMLYQNVDSTPSTHSSPSMNVMTTGKNSMTITPALNTATAATGPTQSSVPLYSSDISKEQIQDFVDMNQIFGTSEYSKDRNSNSNTPNSVIPGRSLNFQHSRLPTSNQHQNQSAICEINNYDVCANDFGQCGGVGAGVETNSHSNTNSITLTTSSMGNGINSSVHGYDIPIKTELTSNPQEYISNVLNTDFNELKLSQDEQHQQQGGMNNLGSQSNYNYQLMFDEELNQPQQTTHNPHTLWEEPHGFLQ

SEQ ID NO: 31 - DNA, 1494 bp, Issatchenkia orientalis
atgacgcactccgactcggggttacacaagaatccttcaatgaggtgtgaagcttcaccaagtaactttggatccgaatttgaagatggaatgtcgcatggagtacaatcctgtgatgcccctgataggggaatgtatacaacttcgtattgtcccatcaaggataccattatgatgcacaagtcgtcatcacaagcgtcatcacaagcgtcatcacaagcgtcatcacaagtgccatcacaagtgccatcacaagcgtcatcacaagcttcatcacaagcgtcctcctcgtgttgctccacaaattcggctccctgctcccctacttcaccattgattctatcgagtgaggggagagaaaataaggtacattgttccaacagcatgacaaagttgaagttggaaaatcgccatttcaccaacaaggcagacattaagccatggttacagagaaacctggcctccatggggatccatattgtaattgagagatcagatgatacaaagattgtcttcaaatgcaagtattcggacaagaagccactggagaaaaataactgcaaatcccatgagagagcagctaggcagcggaaaaagaaggtttgcccctttagaatcagggccaactattccattcgatccaaacactggacattggttatagtcaatgattctcataatcaccctatttccagtttggacgtcaatatagctgatattaagtccaaattgtcgataattgaccagaaaaaatcaaatcatcgggttactaagccgaaaagtttgaaacataaagaccatttgccagtacctcgagcctttgccattgacccctcaaatgctttatcgtcaacttctctgacttgcaaaccttatcataatagtctcatacctccaatattaaatgaaaatacacatgcaaaggttaaactccctcccatctcattgccagataactcattgaataaccaagttagacaaattgaagatactttgaaaaccttccaacaggttggtaatatacccaatgtttcaaaagaaaaaatcttaaaggatgtctggtgcgtcttgaataaatcaatcaatgaaatcaccgactccaattcagggagctttcctctaccattacccctaccgttaccacaccaaaaaatgggcagagtatctcaaagacaatctttccaattgttcaatactaataacaacattgagaataatgttattaatggcaatctcgaaaatagcaacactagcagccgaagcagcagcaacagtatcaacgacatcaacgacatcaacgacatcaacgacatcaacttggctagtaataacatgtacttgaataactatgctaaaagcaatacctttacatctccacatttcaagcttccaagataccaattttcaaatgcatctcttggaccactgataaaatctgcccatgatcgaaacatcagtttgccaagtatccgaaacctagactcaggcgcctag

SEQ ID NO: 32 - protein, 497 aa, Issatchenkia orientalis
MTHSDSGLHKNPSMRCEASPSNFGSEFEDGMSHGVQSCDAPDRGMYTTSYCPIKDTIMMHKSSSQASSQASSQASSQVPSQVPSQASSQASSQASSSCCSTNSAPCSPTSPLILSSEGRENKVHCSNSMTKLKLENRHFTNKADIKPWLQRNLASMGIHIVIERSDDTKIVFKCKYSDKKPLEKNNCKSHERAARQRKKKVCPFRIRANYSIRSKHWTLVIVNDSHNHPISSLDVNIADIKSKLSIIDQKKSNHRVTKPKSLKHKDHLPVPRAFAIDPSNALSSTSLTCKPYHNSLIPPILNENTHAKVKLPPISLPDNSLNNQVRQIEDTLKTFQQVGNIPNVSKEKILKDVWCVLNKSINEITDSNSGSFPLPLPLPLPHQKMGRVSQRQSFQLFNTNNNIENNVINGNLENSNTSSRSSSNSINDINDINDINDINLASNNMYLNNYAKSNTFTSPHFKLPRYQFSNASLGPLIKSAHDRNISLPSIRNLDSGA

SEQ ID NO: 33 - DNA, 1434 bp, Issatchenkia orientalis
atgacgcactccgactcggggttacacaagaatccttcaatgaggtgtgaagcttcaccaagtaactttggatccgaatttgaagatggaatgtcgcatggagtacaatcctgtgatgcccctgataggggaatgtatacaacttcgtattgtcccatcaaggataccattatgatgcacaagtcgtcatcacaagcgtcatcacaagcttcatcacaagcgtcctcctcgtgttgctccacaaattcggctccctgctcccctacttcaccattgattctatcgagtgaggggagagaaaataaggtacattgttccaacagcatgacaaagttgaagttggaaaatcgccatttcaccaacaaggcagacattaagccatggttacagagaaacctggcctccatggggatccatattgtaattgagagatcagatgatacaaagattgtcttcaaatgcaagtattcggacaagaagccactggagaaaaataactgcaaatcccatgagagagcagctaggcagcggaaaaagaaggtttgcccctttagaatcagggccaactattccattcgatccaaacactggacattggttatagtcaatgattctcataatcaccctatttccagtttggacgtcaatatagctgatattaagtccaaattgtcgataattgaccagaaaaaatcaaatcatcgggttactaagccgaaaagtttgaaacataaagaccatttgccagtacctcgagcctttgccattgacccctcaaatgctttatcgtcaacttctctgacttgcaaaccttatcataatagtctcatacctccaatattaaatgaaaatacacatgcaaaggttaaactccctcccatctcattgccagataactcattgaataaccaagttagacaaattgaagatactttgaaaaccttccaacaggttggtaatatacccaatgtttcaaaagaaaaaatcttaaaggatgtctggtgcgtcttgaataaatcaatcaatgaaatcaccgactccaattcagggagctttcctctaccattacccctaccgttaccacaccaaaaaatgggcagagtatctcaaagacaatctttccaattgttcaatactaataacaacattgagaataatgttattaatggcaatctcgaaaatagcaacactagcagccgaagcagcagcaacagtatcaacgacatcaacgacatcaacgacatcaacgacatcaacttggctagtaataacatgtacttgaataactatgctaaaagcaatacctttacatctccacatttcaagcttccaagataccaattttcaaatgcatctcttggaccactgataaaatctgcccatgatcgaaacatcagtttgccaagtatccgaaacctagactcaggcgcctag

SEQ ID NO: 34 - protein, 477 aa, Issatchenkia orientalis
MTHSDSGLHKNPSMRCEASPSNFGSEFEDGMSHGVQSCDAPDRGMYTTSYCPIKDTIMMHKSSSQASSQASSQASSSCCSTNSAPCSPTSPLILSSEGRENKVHCSNSMTKLKLENRHFTNKADIKPWLQRNLASMGIHIVIERSDDTKIVFKCKYSDKKPLEKNNCKSHERAARQRKKKVCPFRIRANYSIRSKHWTLVIVNDSHNHPISSLDVNIADIKSKLSIIDQKKSNHRVTKPKSLKHKDHLPVPRAFAIDPSNALSSTSLTCKPYHNSLIPPILNENTHAKVKLPPISLPDNSLNNQVRQIEDTLKTFQQVGNIPNVSKEKILKDVWCVLNKSINEITDSNSGSFPLPLPLPLPHQKMGRVSQRQSFQLFNTNNNIENNVINGNLENSNTSSRSSSNSINDINDINDINDINLASNNMYLNNYAKSNTFTSPHFKLPRYQFSNASLGPLIKSAHDRNISLPSIRNLDSGA

SEQ ID NO: 35 - DNA, 1203 bp, Saccharomyces bayanus
atgtcaaaaacaggaaagatgaggttgacggcatctcctgataacctagcgtctatgatgtctagagaccaaaacaagcttattcatctggacccggtcccatttttcaaagacagacatgaaatcaaaccatggttacaaaagatcttttatccccagggaatagatatagtcattgaaaggtcagattctggcaaagtcacttttaaatgtagatcagtacgatccaacgggaggctgaatcctgaatccaaaggcacctcttcaaggtcgcatgcatgtccatttagaatcagagccgccttctctgtacggttacagaagtggaatgtggttgtcatgaataatatacatgcgcacgagctgaggtttgatctaatcactaaaacagatgactataaaaaatttaaagaaacccttcgccagaaacatgacgaaaaggcaatcaaaacctttgatgaactagaatacaaggccagcctaaacttaccgctcgtgacaccgattatctcctgtgactgtggtctgaccaaagaaattgaagctttcaataatatatatcttccgatatcaaatccttctttgacgtctaaaaaaagtatactcaaggctaataaaaattctgtgtctaaggtaaaacctaaacaaccggaaaattcaaagcctgggctgaggttgaaaacacaattagattcaactctgaatgcaaccagatttttggatgacatcaaagtacaaagcgctcttgtatcgacaggaagtgccgagtcactaatgaacttgaacgaaatcgacttcaccaatatgtttaataacgatagtgctattccaaatcccaatcaaggactgatggatttctcagtggatcccattgcaggaccttcctcttcttctctatttccttcaacgcccaccgagcctttttcacaaaacaacgtgccactagctatttcggagtcaataacatcttcttctccaaatttcatggaaatgaagacttcttatgaagatgaaatcatggagcttttcaaagataataaaagcaatgcaccaacttctgatacggatatcaatacagatttaggtaagggcataagcgatagttttggcatgttaaactataattacgaagcattgcttcactttaatgatgacgaatttagtgaattgaagtctatcgatccggcattgatatcaaagtaa

SEQ ID NO: 36 - protein, 400 aa, Saccharomyces bayanus
MSKTGKMRLTASPDNLASMMSRDQNKLIHLDPVPFFKDRHEIKPWLQKIFYPQGIDIVIERSDSGKVTFKCRSVRSNGRLNPESKGTSSRSHACPFRIRAAFSVRLQKWNVVVMNNIHAHELRFDLITKTDDYKKFKETLRQKHDEKAIKTFDELEYKASLNLPLVTPIISCDCGLTKEIEAFNNIYLPISNPSLTSKKSILKANKNSVSKVKPKQPENSKPGLRLKTQLDSTLNATRFLDDIKVQSALVSTGSAESLMNLNEIDFTNMFNNDSAIPNPNQGLMDFSVDPIAGPSSSSLFPSTPTEPFSQNNVPLAISESITSSSPNFMEMKTSYEDEIMELFKDNKSNAPTSDTDINTDLGKGISDSFGMLNYNYEALLHFNDDEFSELKSIDPALISK

SEQ ID NO: 37 - DNA, 2205 bp, Saccharomyces castelli
atgaatggagacaataaaggaacgagtggatcttcaccatttgggaactttagcgaaagtgcattcaattctggagctaaccaaacggctaccgctggacaagacaccaaaaataagccatcgacctccatgttcggtaatactgctaaaactggaacaactccaatgtttggttctacagggactgcgaataagggtgctttcacagggtttggtacagcctcatctacattcggtagtatggcaaacgcatcaacctcaaataccgatggaaagacaggcactacaggatttagctttggcaacgcagctaacgcaaaacctggggctgaaactgcaaccaatgactcaaataaaccaaatacctttgcacttggaaattcttccacgccagcttccggtactctctttggcaataaatctggatcaaccgccacaccaatgtttaacatgggaggtgcaacatctgctgataagatttctaacccagcctccaccttttcgtttggagcttctgacaagaaggatgattcgaagcctggattttcatttaatcaaaatacgggagggaaccaaccaagcaccacagaaacaaataaaccagcattctcctttggagcaacaagtgatggaaaagattctgctgctaagccaactttgagttttggaacagctccaggcacaaacgattctacaaaaccattctcttttggaacaagcactggagctaaagaatcaacatcgacacctgcttttactctgggaggagctaaagaggcacccaacacaactccttcattttcattaggaagcgctagtaacgacaaaaactctgcttcgaagcctgggtttacacttggtgcaacccttgggactcaaacagataaaaacaacactgaaacaaaacccgcctttagttttgcttccactcctacagaggatactaccaaaagtgcgtcatctatatcacttccttcaaataatggtgataccgccaaaccagctttttcattctcaagtaaatctacagaagataaatcaaccaatgaaagctctacaacaaaaccaaccctttctttcggggcaaaacctgaagttaaagagactacagatactaagtcatccacagttactatgccagcattttcttttggagagaaaccgagggagggtaccggtaatgcaccaactttttcattaggtaaaaaaccagaagaacaagataaagcagctgccgctccaagtttctcattgggcaaaaagtcagatgaaaatggtagtgcaactccagctccagcattttcatttggaaagaaacctgaagaaaaggcaaacgctacgtctgcaccaactttctctttagctaaaaaagcagacgaaaaagacagtacgactgctgctccagcgttttcatttggaaagaagtcagaagaaaaggattcagctgctaaggacacatcgacaaaaacaggtttctcatttggtaataaagctgacgagaagaagcccgagggtaccactctgaaaaaggaagatatcaaatctaacgtctccgaaaagacttttgaaaattctaccaagactggaggtcttgatacgaaaccagtggaactaaaaccagtttcacttgacaataagaccttggacgatctaataacaaaatggacaaatgacttaacaaaagcggctgttcacttcgatgagtattcaaagaagattaattcttgggatcagatgctagtaaagggcggtgaacaagtaagccagttatattctgacacattggctacggaacaaactcaaaatagaatagatcaatcgttacaatatattgaaaggcagcaggatgaattagagatatttttagataactatgaaagaaaggccgacactttattatctgacattttatcaacaactgctgtcaataccgcaagcaataacgaccagaagaggcaacaggcgtatcacactgcagaaactcttgatgaaaacttaagtgctctctcttcaaacctatcctcattgataaatgaaattaatgatgttagcaacagtttcaacaaggcaacaagtatcaatttaggaaacaaagatgaaaactctcaattgatgaaattattgaattcacatttagacgcattgaaatcgttagacgacaattcgtccttattagaacaaaaaatcaaatcattctctaaataa

SEQ ID NO: 38 - protein, 734 aa, Saccharomyces castelli
MNGDNKGTSGSSPFGNFSESAFNSGANQTATAGQDTKNKPSTSMFGNTAKTGTTPMFGSTGTANKGAFTGFGTASSTFGSMANASTSNTDGKTGTTGFSFGNAANAKPGAETATNDSNKPNTFALGNSSTPASGTLFGNKSGSTATPMFNMGGATSADKISNPASTFSFGASDKKDDSKPGFSFNQNTGGNQPSTTETNKPAFSFGATSDGKDSAAKPTLSFGTAPGTNDSTKPFSFGTSTGAKESTSTPAFTLGGAKEAPNTTPSFSLGSASNDKNSASKPGFTLGATLGTQTDKNNTETKPAFSFASTPTEDTTKSASSISLPSNNGDTAKPAFSFSSKSTEDKSTNESSTTKPTLSFGAKPEVKETTDTKSSTVTMPAFSFGEKPREGTGNAPTFSLGKKPEEQDKAAAAPSFSLGKKSDENGSATPAPAFSFGKKPEEKANATSAPTFSLAKKADEKDSTTAAPAFSFGKKSEEKDSAAKDTSTKTGFSFGNKADEKKPEGTTLKKEDIKSNVSEKTFENSTKTGGLDTKPVELKPVSLDNKTLDDLITKWTNDLTKAAVHFDEYSKKINSWDQMLVKGGEQVSQLYSDTLATEQTQNRIDQSLQYIERQQDELEIFLDNYERKADTLLSDILSTTAVNTASNNDQKRQQAYHTAETLDENLSALSSNLSSLINEINDVSNSFNKATSINLGNKDENSQLMKLLNSHLDALKSLDDNSSLLEQKIKSFSK

SEQ ID NO: 39 - protein, 40 aa, Artificial Sequence
  2Fe-2S cluster protein motif
  MISC_FEATURE (2)..(5): Xaa may be any amino acid
  MISC_FEATURE (7)..(8): Xaa may be any amino acid
  MISC_FEATURE (10)..(39): Xaa may be any amino acid
CXXXXCXXCXXXXXXXXXXXXXXXXXXXXXXXXXXXXXXC

SEQ ID NO: 40 - DNA, 1716 bp, Bacillus subtilis
atgttgactaaagctacaaaagagcagaaatcattggtgaaaaataggggtgcagaacttgttgtggactgtttggtagaacagggcgtaacacatgtttttggtatcccaggtgcaaaaatcgacgccgtgtttgatgcattacaagacaagggtccagaaattattgttgctagacatgagcaaaatgccgcatttatggcgcaagctgtaggtaggcttacaggtaaacctggtgttgtcctagttacgtctggcccaggagcctccaatttagcaactggtctattgacagctaatactgagggagatcctgtagttgcgttagccggtaatgtaattagagctgataggcttaagagaactcaccagtctctagacaacgctgctttattccaaccgatcaccaagtactcagtagaggtacaagacgtaaagaatatacctgaagctgtgacaaacgcatttcgtatagcttctgctggtcaggctggtgccgcgtttgtttcttttcctcaagacgttgtcaatgaagtgaccaatactaaaaacgttagagcggttgcagcccctaaactaggtccagccgcagacgacgcaattagcgctgcaattgctaaaattcagacggcgaaactaccagtagtccttgtcggtatgaagggcggaagaccagaagcaataaaagctgttcgtaagttattgaagaaagtccaattacctttcgttgagacttaccaagcagcaggtactttatctagagatttagaggatcagtattttggaaggataggtctatttagaaaccaaccaggagatttactattagaacaagctgatgttgtacttactatcggttatgatcctatagagtatgacccaaagttttggaacataaatggggatagaacaattatacatctagacgagataatcgccgacatcgatcacgcttatcaaccagatttagaactaatcggagatatcccgtcaacaatcaatcatattgaacatgatgctgtaaaggttgagttcgctgaacgtgagcagaaaatcttatctgatctaaagcaatatatgcatgagggtgaacaagttccagcagactggaaatctgaccgtgcacatcctttggaaatcgttaaggaactaagaaatgcggtcgatgatcatgtgactgttacatgtgatatcggttcacatgcaatttggatgtcacgttattttaggagctacgaaccattaactttaatgatatctaacgggatgcaaactctgggggttgcacttccttgggctattggcgctagtttagttaagcccggtgagaaggtggtatcggtatcaggtgatggtggctttctgttttcggctatggaattagaaactgcagtccgtttaaaagctcccattgtgcatattgtctggaatgattctacttacgacatggttgcttttcaacagttgaagaaatacaatagaacttcggctgtagactttggtaacatcgatattgtgaaatatgctgagtcttttggcgcaacaggcctgagggtggaaagtccagatcagttagctgatgtgttgagacaagggatgaatgccgagggaccggtaatcatagatgtgccagttgactactcagacaatattaatttggcttctgataaacttcctaaagagtttggcgagctaatgaagaccaaagccttataa

SEQ ID NO: 41 - protein, 571 aa, Bacillus subtilis
MLTKATKEQKSLVKNRGAELVVDCLVEQGVTHVFGIPGAKIDAVFDALQDKGPEIIVARHEQNAAFMAQAVGRLTGKPGVVLVTSGPGASNLATGLLTANTEGDPVVALAGNVIRADRLKRTHQSLDNAALFQPITKYSVEVQDVKNIPEAVTNAFRIASAGQAGAAFVSFPQDVVNEVTNTKNVRAVAAPKLGPAADDAISAAIAKIQTAKLPVVLVGMKGGRPEAIKAVRKLLKKVQLPFVETYQAAGTLSRDLEDQYFGRIGLFRNQPGDLLLEQADVVLTIGYDPIEYDPKFWNINGDRTIIHLDEIIADIDHAYQPDLELIGDIPSTINHIEHDAVKVEFAEREQKILSDLKQYMHEGEQVPADWKSDRAHPLEIVKELRNAVDDHVTVTCDIGSHAIWMSRYFRSYEPLTLMISNGMQTLGVALPWAIGASLVKPGEKVVSVSGDGGFLFSAMELETAVRLKAPIVHIVWNDSTYDMVAFQQLKKYNRTSAVDFGNIDIVKYAESFGATGLRVESPDQLADVLRQGMNAEGPVIIDVPVDYSDNINLASDKLPKEFGELMKTKAL

SEQ ID NO: 42 - DNA, 1476 bp, Artificial Sequence
  Nucleotide sequence for E. coli ilvCQ110V
atggccaactattttaacacattaaatttgagacaacaattggctcaactgggtaagtgcagatttatgggaagggacgagtttgctgatggtgcttcttatctgcaaggaaagaaagtagtaattgttggctgcggtgctcagggtctaaaccaaggtttaaacatgagagattcaggtctggatatttcgtatgcattgaggaaagaggcaattgcagaaaagagggcctcctggcgtaaagcgacggaaaatgggttcaaagttggtacttacgaagaactgatccctcaggcagatttagtgattaacctaacaccagataaggttcactcagacgtagtaagaacagttcaaccgctgatgaaggatggggcagctttaggttactctcatggctttaatatcgttgaagtgggcgagcagatcagaaaagatataacagtcgtaatggttgcaccaaagtgcccaggtacggaagtcagagaggagtacaagaggggttttggtgtacctacattgatcgccgtacatcctgaaaatgaccccaaaggtgaaggtatggcaattgcgaaggcatgggcagccgcaaccggaggtcatagagcgggtgtgttagagagttctttcgtagctgaggtcaagagtgacttaatgggtgaacaaaccattctgtgcggaatgttgcaggcagggtctttactatgctttgataaattggtcgaagagggtacagatcctgcctatgctgaaaagttgatacaatttggttgggagacaatcaccgaggcacttaaacaaggtggcataacattgatgatggatagactttcaaatccggccaagctaagagcctacgccttatctgagcaactaaaagagatcatggcaccattattccaaaagcacatggacgatattatctccggtgagttttcctcaggaatgatggcagattgggcaaacgatgataaaaagttattgacgtggagagaagaaaccggcaagacggcattcgagacagccccacaatacgaaggtaaaattggtgaacaagaatactttgataagggagtattgatgatagctatggtgaaggcaggggtagaacttgcattcgaaactatggttgactccggtatcattgaagaatctgcatactatgagtctttgcatgaattgcctttgatagcaaatactattgcaagaaaaagactttacgagatgaatgttgtcatatcagacactgcagaatatggtaattacttatttagctacgcatgtgtcccgttgttaaagcccttcatggccgagttacaacctggtgatttggggaaggctattccggaaggagcggttgacaatggccaactgagagacgtaaatgaagctattcgttcacatgctatagaacaggtgggtaaaaagctgagaggatatatgaccgatatgaaaagaattgcagtggcaggatga

SEQ ID NO: 43 - protein, 493 aa, Artificial Sequence
  Amino acid sequence for E. coli ilvCQ110V
MANYFNTLNLRQQLAQLGKCRFMGRDEFADGASYLQGKKVVIVGCGAQGLNQGLNMRDSGLDISYALRKEAIAEKRASWRKATENGFKVGTYEELIPQADLVINLTPDKVHSDVVRTVQPLMKDGAALGYSHGFNIVEVGEQIRKDITVVMVAPKCPGTEVREEYKRGFGVPTLIAVHPENDPKGEGMAIAKAWAAATGGHRAGVLESSFVAEVKSDLMGEQTILCGMLQAGSLLCFDKLVEEGTDPAYAEKLIQFGWETITEALKQGGITLMMDRLSNPAKLRAYALSEQLKEIMAPLFQKHMDDIISGEFSSGMMADWANDDKKLLTWREETGKTAFETAPQYEGKIGEQEYFDKGVLMIAMVKAGVELAFETMVDSGIIEESAYYESLHELPLIANTIARKRLYEMNVVISDTAEYGNYLFSYACVPLLKPFMAELQPGDLGKAIPEGAVDNGQLRDVNEAIRSHAIEQVGKKLRGYMTDMKRIAVAGLE

SEQ ID NO: 44 - DNA, 1476 bp, Artificial Sequence
  Nucleotide sequence for E. coli ilvC coScP2D1-A1
atggccaactattttaacacattaaatttgagacaacaattggctcaactgggtaagtgcagatttatgggaagggacgagtttgctgatggtgcttcttatctgcaaggaaagaaagtagtaattgttggctgcggtgctcagggtctaaaccaaggtttaaacatgagagattcaggtctggatatttcgtatgcattgaggaaagagtctattgcagaaaaggatgccgattggcgtaaagcgacggaaaatgggttcaaagttggtacttacgaagaactgatccctcaggcagatttagtgattaacctaacaccagataaggttcactcagacgtagtaagaacagttcaaccgctgatgaaggatggggcagctttaggttactctcatggctttaatatcgttgaagtgggcgagcagatcagaaaaggtataacagtcgtaatggttgcgccaaagtgcccaggtacggaagtcagagaggagtacaagaggggttttggtgtacctacattgatcgccgtacatcctgaaaatgaccccaaacgtgaaggtatggcaatagcgaaggcatgggcagccgcaaccggaggtcatagagcgggtgtgttagagagttctttcgtagctgaggtcaagagtgacttaatgggtgaacaaaccattctgtgcggaatgttgcaggcagggtctttactatgctttgataaattggtcgaagagggtacagatcctgcctatgctgaaaagttgatacaatttggttgggagacaatcaccgaggcacttaaacaaggtggcataacattgatgatggatagactttcaaatccggccaagctaagagcctacgccttatctgagcaactaaaagagatcatggcaccattattccaaaagcacatggacgatattatctccggtgagttttcctcaggaatgatggcagattgggcaaacgatgataaaaagttattgacgtggagagaagaaaccggcaagacggcattcgagacagccccacaatacgaaggtaaaattggtgaacaagaatactttgataagggagtattgatgatagctatggtgaaggcaggggtagaacttgcattcgaaactatggttgactccggtatcattgaagaatctgcatactatgagtctttgcatgaattgcctttgatagcaaatactattgcaagaaaaagactttacgagatgaatgttgtcatatcagacactgcagaatatggtaattacttatttagctacgcgtgtgtcccgttgttagagcccttcatggccgagttacaacctggtgatttggggaaggctattccggaaggagcggttgacaatggccaactgagagacgtaaatgaagctattcgttcgcatgctatagaacaggtgggtaaaaagctgagaggatatatgaccgatatgaaaagaattgcagtggcaggatga

SEQ ID NO: 45 - protein, 491 aa, Artificial Sequence
  Amino acid sequence for E coli IlvCP2D1-A1
MANYFNTLNLRQQLAQLGKCRFMGRDEFADGASYLQGKKVVIVGCGAQGLNQGLNMRDSGLDISYALRKESIAEKDADWRKATENGFKVGTYEELIPQADLVINLTPDKVHSDVVRTVQPLMKDGAALGYSHGFNIVEVGEQIRKGITVVMVAPKCPGTEVREEYKRGFGVPTLIAVHPENDPKREGMAIAKAWAAATGGHRAGVLESSFVAEVKSDLMGEQTILCGMLQAGSLLCFDKLVEEGTDPAYAEKLIQFGWETITEALKQGGITLMMDRLSNPAKLRAYALSEQLKEIMAPLFQKHMDDIISGEFSSGMMADWANDDKKLLTWREETGKTAFETAPQYEGKIGEQEYFDKGVLMIAMVKAGVELAFETMVDSGIIEESAYYESLHELPLIANTIARKRLYEMNVVISDTAEYGNYLFSYACVPLLEPFMAELQPGDLGKAIPEGAVDNGQLRDVNEAIRSHAIEQVGKKLRGYMTDMKRIAVAG

SEQ ID NO: 46 - DNA, 1647 bp, Lactococcus lactis
atgtatactgttggtgattatctgctggaccgtctgcatgaactgggtatcgaagaaatcttcggcgttccgggtgattacaatctgcagttcctggatcagatcatctctcataaagacatgaaatgggtgggtaacgctaacgaactgaacgcaagctacatggcagatggttatgcacgtaccaagaaagccgcggcatttctgaccactttcggtgttggcgaactgagcgccgtcaacggtctggcgggctcctacgccgaaaacctgccggtggtggagatcgtaggcagcccaacgagcaaagttcagaacgaaggtaaattcgtccaccacactctggctgacggcgatttcaaacacttcatgaaaatgcatgaacctgtgactgcggcacgtacgctgctgactgcagagaacgctactgtggaaatcgaccgcgttctgtctgcgctgctgaaagaacgcaaaccagtttacatcaacctgcctgtggatgttgcggcagctaaagcggaaaaaccgagcctgccgctgaagaaagaaaactccacttctaacactagcgaccaggaaatcctgaacaaaatccaggagtctctgaaaaacgcaaagaaaccaatcgtgatcaccggccacgaaatcatttcttttggtctggagaagaccgtgacccaattcatcagcaaaaccaaactgccgattaccaccctgaacttcggcaagtcctctgttgacgaggctctgccgtctttcctgggcatctacaacggtactctgagcgaaccgaacctgaaagaatttgttgaatctgcggacttcatcctgatgctgggcgttaaactgaccgactcttctaccggtgcattcactcaccatctgaacgaaaacaaaatgattagcctgaacatcgacgagggtaaaatcttcaacgagcgtatccagaacttcgacttcgaaagcctgatcagctctctgctggacctgtccgaaatcgagtataaaggcaaatacattgacaaaaagcaagaagatttcgtaccatctaacgcactgctgtcccaggatcgcctgtggcaggccgtggagaacctgacccagagcaatgaaaccatcgtggcggaacaaggtacgagctttttcggcgcgtcttctatctttctgaaatccaaaagccattttatcggtcagccgctgtggggtagcattggctatactttcccggcagcgctgggctctcagatcgctgataaagaatctcgtcatctgctgttcatcggtgacggttccctgcagctgaccgtacaggaactgggtctggcaattcgtgaaaagatcaacccgatttgcttcattattaacaatgacggctacaccgttgagcgtgagatccacggtccgaaccagtcttacaacgatatccctatgtggaactactctaaactgccggagtccttcggcgcaactgaggaccgtgttgtgtctaaaattgtgcgtaccgaaaacgaatttgtgagcgtgatgaaagaggcccaggccgatccgaaccgtatgtactggatcgaactgatcctggcgaaagaaggcgcaccgaaggtactgaagaaaatgggcaagctgtttgctgaacagaataaatcctaa

SEQ ID NO: 47 - protein, 548 aa, Lactococcus lactis
MYTVGDYLLDRLHELGIEEIFGVPGDYNLQFLDQIISHKDMKWVGNANELNASYMADGYARTKKAAAFLTTFGVGELSAVNGLAGSYAENLPVVEIVGSPTSKVQNEGKFVHHTLADGDFKHFMKMHEPVTAARTLLTAENATVEIDRVLSALLKERKPVYINLPVDVAAAKAEKPSLPLKKENSTSNTSDQEILNKIQESLKNAKKPIVITGHEIISFGLEKTVTQFISKTKLPITTLNFGKSSVDEALPSFLGIYNGTLSEPNLKEFVESADFILMLGVKLTDSSTGAFTHHLNENKMISLNIDEGKIFNERIQNFDFESLISSLLDLSEIEYKGKYIDKKQEDFVPSNALLSQDRLWQAVENLTQSNETIVAEQGTSFFGASSIFLKSKSHFIGQPLWGSIGYTFPAALGSQIADKESRHLLFIGDGSLQLTVQELGLAIREKINPICFIINNDGYTVEREIHGPNQSYNDIPMWNYSKLPESFGATEDRVVSKIVRTENEFVSVMKEAQADPNRMYWIELILAKEGAPKVLKKMGKLFAEQNKS

SEQ ID NO: 48 - DNA, 1713 bp, Lactococcus lactis
atggagtttaagtataacggcaaagttgaatctgttgaactgaataagtacagcaaaacgttgacacaagatcccacacaacccgccacacaggcaatgtattacggcatcgggtttaaagacgaagatttcaagaaagctcaagtgggtatagtgtcgatggactgggatggaaatccatgcaacatgcatttaggaacccttggatcaaagattaaaagctcagtaaatcagacagatggtctgatcggcttacaatttcatacgataggagtttctgatgggatagcaaatggaaagttgggaatgagatactcccttgtttccagagaagttatagctgactctattgaaaccaacgctggcgctgaatactatgatgcaattgtagccatcccaggttgtgacaaaaatatgccaggttctattattggtatggcaagacttaataggccaagcattatggtgtatggaggaacaatagaacacggtgaatataaaggtgagaaattgaacatcgtatcggcttttgaatctctaggccagaaaattaccggcaatatctctgatgaagattatcacggtgttatttgtaatgctattcctggtcaaggggcatgtggggggatgtacacagctaataccttagctgccgctatcgaaacactaggtatgtcattgccgtattcttcttcgaaccctgcagtatctcaagaaaaacaagaagaatgtgatgagattggattagccattaagaatcttttggaaaaagacatcaagcctagtgatataatgactaaggaggcgttcgagaacgctattaccattgtgatggtcttggggggtagtactaatgctgtcttgcatattattgcaatggctaacgcgataggtgtcgaaataactcaggatgacttccaaagaattagtgacattactccagtactaggtgattttaaaccttcaggtaaatatatgatggaagatttgcataaaattggaggcttgccagcagtgcttaagtaccttctaaaggaaggaaaattgcatggtgactgccttactgtgacgggtaaaacattagccgagaatgtcgagactgccctagacttggatttcgactcacaagatatcatgaggccactaaagaatcctatcaaggccaccggccacttgcagattctgtacggtaatttagctcaagggggttccgtagcaaaaattagcggtaaagaaggagagttcttcaaaggcactgccagagtctttgatggtgaacaacattttatcgacggcatagaatctggtcgtttgcatgctggagatgtagcggtaattaggaatataggtcccgtcggcggacctggtatgcccgaaatgctgaagcctacatcagcattaattggtgcgggtttagggaaaagttgcgcgttaattacggatggtagattctccggtggcactcacggttttgttgtcggccatattgtgcctgaagccgttgagggtggactaatcggcttagttgaagatgacgatataatagagatagatgcagtcaacaactctatatccctgaaagtttccgatgaagaaatcgcaaagagaagagctaattatcagaagccaactccgaaagccaccaggggagttttggcaaaattcgctaaattaacccgtcctgcatcggaagggtgtgttactgatctgtaa

SEQ ID NO: 49 - protein, 570 aa, Lactococcus lactis
MEFKYNGKVESVELNKYSKTLTQDPTQPATQAMYYGIGFKDEDFKKAQVGIVSMDWDGNPCNMHLGTLGSKIKSSVNQTDGLIGLQFHTIGVSDGIANGKLGMRYSLVSREVIADSIETNAGAEYYDAIVAIPGCDKNMPGSIIGMARLNRPSIMVYGGTIEHGEYKGEKLNIVSAFESLGQKITGNISDEDYHGVICNAIPGQGACGGMYTANTLAAAIETLGMSLPYSSSNPAVSQEKQEECDEIGLAIKNLLEKDIKPSDIMTKEAFENAITIVMVLGGSTNAVLHIIAMANAIGVEITQDDFQRISDITPVLGDFKPSGKYMMEDLHKIGGLPAVLKYLLKEGKLHGDCLTVTGKTLAENVETALDLDFDSQDIMRPLKNPIKATGHLQILYGNLAQGGSVAKISGKEGEFFKGTARVFDGEQHFIDGIESGRLHAGDVAVIRNIGPVGGPGMPEMLKPTSALIGAGLGKSCALITDGRFSGGTHGFVVGHIVPEAVEGGLIGLVEDDDIIEIDAVNNSISLKVSDEEIAKRRANYQKPTPKATRGVLAKFAKLTRPASEGCVTDL

SEQ ID NO: 50 - DNA, 1701 bp, Artificial Sequence
  Nucleotide sequence for Saccharomyces cerevisiae ILV3deltaN
atgaagaagctcaacaagtactcgtatatcatcactgaacctaagggccaaggtgcgtcccaggccatgctttatgccaccggtttcaagaaggaagatttcaagaagcctcaagtcggggttggttcctgttggtggtccggtaacccatgtaacatgcatctattggacttgaataacagatgttctcaatccattgaaaaagcgggtttgaaagctatgcagttcaacaccatcggtgtttcagacggtatctctatgggtactaaaggtatgagatactcgttacaaagtagagaaatcattgcagactcctttgaaaccatcatgatggcacaacactacgatgctaacatcgccatcccatcatgtgacaaaaacatgcccggtgtcatgatggccatgggtagacataacagaccttccatcatggtatatggtggtactatcttgcccggtcatccaacatgtggttcttcgaagatctctaaaaacatcgatatcgtctctgcgttccaatcctacggtgaatatatttccaagcaattcactgaagaagaaagagaagatgttgtggaacatgcatgcccaggtcctggttcttgtggtggtatgtatactgccaacacaatggcttctgccgctgaagtgctaggtttgaccattccaaactcctcttccttcccagccgtttccaaggagaagttagctgagtgtgacaacattggtgaatacatcaagaagacaatggaattgggtattttacctcgtgatatcctcacaaaagaggcttttgaaaacgccattacttatgtcgttgcaaccggtgggtccactaatgctgttttgcatttggtggctgttgctcactctgcgggtgtcaagttgtcaccagatgatttccaaagaatcagtgatactacaccattgatcggtgacttcaaaccttctggtaaatacgtcatggccgatttgattaacgttggtggtacccaatctgtgattaagtatctatatgaaaacaacatgttgcacggtaacacaatgactgttaccggtgacactttggcagaacgtgcaaagaaagcaccaagcctacctgaaggacaagagattattaagccactctcccacccaatcaaggccaacggtcacttgcaaattctgtacggttcattggcaccaggtggagctgtgggtaaaattaccggtaaggaaggtacttacttcaagggtagagcacgtgtgttcgaagaggaaggtgcctttattgaagccttggaaagaggtgaaatcaagaagggtgaaaaaaccgttgttgttatcagatatgaaggtccaagaggtgcaccaggtatgcctgaaatgctaaagccttcctctgctctgatgggttacggtttgggtaaagatgttgcattgttgactgatggtagattctctggtggttctcacgggttcttaatcggccacattgttcccgaagccgctgaaggtggtcctatcgggttggtcagagacggcgatgagattatcattgatgctgataataacaagattgacctattagtctctgataaggaaatggctcaacgtaaacaaagttgggttgcacctccacctcgttacacaagaggtactctatccaagtatgctaagttggtttccaacgcttccaacggttgtgttttagatgcttga

SEQ ID NO: 51 - protein, 566 aa, Artificial Sequence
  Amino acid sequence for Saccharomyces cerevisiae ILV3deltaN
MKKLNKYSYIITEPKGQGASQAMLYATGFKKEDFKKPQVGVGSCWWSGNPCNMHLLDLNNRCSQSIEKAGLKAMQFNTIGVSDGISMGTKGMRYSLQSREIIADSFETIMMAQHYDANIAIPSCDKNMPGVMMAMGRHNRPSIMVYGGTILPGHPTCGSSKISKNIDIVSAFQSYGEYISKQFTEEEREDVVEHACPGPGSCGGMYTANTMASAAEVLGLTIPNSSSFPAVSKEKLAECDNIGEYIKKTMELGILPRDILTKEAFENAITYVVATGGSTNAVLHLVAVAHSAGVKLSPDDFQRISDTTPLIGDFKPSGKYVMADLINVGGTQSVIKYLYENNMLHGNTMTVTGDTLAERAKKAPSLPEGQEIIKPLSHPIKANGHLQILYGSLAPGGAVGKITGKEGTYFKGRARVFEEEGAFIEALERGEIKKGEKTVVVIRYEGPRGAPGMPEMLKPSSALMGYGLGKDVALLTDGRFSGGSHGFLIGHIVPEAAEGGPIGLVRDGDEIIIDADNNKIDLLVSDKEMAQRKQSWVAPPPRYTRGTLSKYAKLVSNASNGCVLDA

SEQ ID NO: 52 - DNA, 1716 bp, Streptococcus mutans
atgactgacaaaaagacacttaaggatttgagaaatagatcctctgtctacgactctatggtgaaatctcctaatagagccatgttaagagcaactgggatgcaagacgaagatttcgaaaagcctatcgtgggtgtgatttctacatgggctgagaacacgccttgcaatatccatcttcacgatttcggtaaactggcaaaggttggagtgaaggaagccggtgcgtggccagtccagttcgggacaataactgtgtcagatggcatcgccatgggtactcaaggtatgaggttttccttgacatcaagagatatcatcgctgattctatagaggcagccatgggtggacataatgccgatgcttttgtagctataggtggttgtgacaaaaacatgccaggctcagtcattgctatggccaatatggatattccagcgattttcgcttatggtgggactattgctccagggaatttggacggtaaagatatcgaccttgtcagcgttttcgagggtgttggccattggaatcatggagacatgaccaaggaagaggttaaagcgctggaatgtaacgcttgtcctggtcctggtggatgcggtggaatgtataccgccaacacaatggcaactgctattgaagtactaggcctttctctacctggctcttcaagtcatccagcagaatctgctgagaaaaaggccgatattgaagaggctggacgtgcagtagtaaagatgttggaaatgggtttgaagccaagtgatatactgactcgtgaggcgttcgaagatgcaattacagtcactatggccttaggcggatcaaccaactctactttgcatcttttagctatcgctcatgcggccaacgtcgaactaacgcttgatgatttcaatacatttcaagagaaagttccacacttggcagacttaaagcctagcggtcaatatgtctttcaagatttgtacaaggtcggaggcgttccagctgttatgaaatacctcctcaaaaacggcttcctacatggtgatagaatcacatgtacaggcaaaacagtagccgaaaacttaaaggcattcgatgatctcactcctggtcaaaaagttatcatgccactggaaaatccaaagagagaagatggaccactgataatcttacacgggaacttggctcctgatggtgccgtagcaaaggtttccggtgttaaggttaggagacacgtcggtccagcaaaagttttcaactctgaggaggaagcaatcgaagctgtgctcaacgatgatatagttgatggcgacgttgtagtggttcgattcgttggaccaaaaggtgggcctggtatgcctgaaatgctatctctgtccagtatgattgtaggaaagggtcagggcgaaaaagtagcattgttaactgatggaagattctctggcggaacatacgggttagtcgtcggccacatcgccccagaagcccaagacggaggcccaatcgcatacttgcaaaccggcgatattgtgacgatagatcaagatacaaaggaactacactttgacattagcgatgaggagcttaagcatagacaggaaaccatcgaattgccaccattgtactcaagaggaatactagggaagtacgcgcatatcgttagttcagcctccagaggggctgttactgacttttggaagccagaggagacaggcaaaaagtaa

SEQ ID NO: 53 - protein, 571 aa, Streptococcus mutans
MTDKKTLKDLRNRSSVYDSMVKSPNRAMLRATGMQDEDFEKPIVGVISTWAENTPCNIHLHDFGKLAKVGVKEAGAWPVQFGTITVSDGIAMGTQGMRFSLTSRDIIADSIEAAMGGHNADAFVAIGGCDKNMPGSVIAMANMDIPAIFAYGGTIAPGNLDGKDIDLVSVFEGVGHWNHGDMTKEEVKALECNACPGPGGCGGMYTANTMATAIEVLGLSLPGSSSHPAESAEKKADIEEAGRAVVKMLEMGLKPSDILTREAFEDAITVTMALGGSTNSTLHLLAIAHAANVELTLDDFNTFQEKVPHLADLKPSGQYVFQDLYKVGGVPAVMKYLLKNGFLHGDRITCTGKTVAENLKAFDDLTPGQKVIMPLENPKREDGPLIILHGNLAPDGAVAKVSGVKVRRHVGPAKVFNSEEEAIEAVLNDDIVDGDVVVVRFVGPKGGPGMPEMLSLSSMIVGKGQGEKVALLTDGRFSGGTYGLVVGHIAPEAQDGGPIAYLQTGDIVTIDQDTKELHFDISDEELKHRQETIELPPLYSRGILGKYAHIVSSASRGAVTDFWKPEETGKK

SEQ ID NO: 54 - DNA, 1923 bp, Neurospora crassa
atggcttctaatcaagataacaaggcagttgctccagacgctgctgcaccagcgggtcagtcaacaaccaccacaactacaaatgataacagtgaaaggaatctaccaaaggaaggcgaatacattcaatggaggacacttccagcgggcaatccagatcagttgaacagatggagtcatttcctgactcgtgagcatgagtttccaggcgctcaggcaatgttgtacggtgcgggtgtacctaacaaagatatgatgaaaaaggctcctcatgttgggatcgctactgtttggtgggaaggtaacccatgtaatactcatctgcttgatctaggtcaaaaagtcaaaaaggctgttgaaagagagaagatgttagcttggcaattcaacacaattggcgttagtgacggaataacaatgggtggtgaaggcatgaggtactctttgcagagcagagagatcatagcagattctatagagactgtgacatgtgcacaacaccatgatgccaatatctcaattccagggtgcgacaaaaacatgccaggcgtcatcatggcagctgcaagacacaacagaccattcgttatgatctacggaggtacaatgagaggcggtcattccgaattacttgatagacctatcaatatcgtaacttgttacgaggcctcaggggcctatacttatggtagacttaagccagcctgtccaaactccactgctaccccatctgacgtgatggacgatatagaacaacacgcctgtccaggggctggagcttgtggagggatgtacaccgcgaatactatggcaaccgccatagaagctatgggtctgacagcaccagggtcatcctcctttccagccagctcaccagaaaagttcagagagtgcgaaaaagccgcggaatacattaagatatgcatggaaaaagatattcgtccaagagacttactaacaaaggcttccttcgagaatgctctcgtcttgacaatgattctaggtggttcaaccaacggtgttttacattacttagccatggccaactccgccgatgtcgatctaactcttgatgatatcaatagagtcagtgctaagactcctttcctcgctgatatggctccatctggtagatactatatggaggatttgtacaaggtaggtggtactccagccgtactcaagatgttgatagctgccggctatatcgatggaacaattccaacaataacaggaaaatctttggctgaaaacgtgtcagattggccatctttagaccctgatcaaaagattatccgtcctttggataatcctatcaaatcacaaggtcacattagagtgctgtatggtaacttctctcctggtggggctgttgccaagatcacgggtaaggaaggtcttagttttactggtaaggcaagatgctttaacaaagagtttgaattggatgctgcgctgaaaaactctgaaatcacgctcgaacaaggaaatcaagttctaattgtaaggtatgaaggccctaagggcggaccaggcatgccagaacaattgaaagcatctgccgctatcatgggcgctggtttgacgaacgtagctttagtcacggatgggcgatactctggcgcttctcacggtttcatcgtcggtcacgtcgtgcctgaggcggcaactggcggacctattgctttagtaaaggatggagatttgatcacaattgatgcagtcagaaatagaattgatgttgtcaaaaccgtagaaggagtggagggcgaggaggaaattgcaaaggttttagaagagaggaaaaagggatggaaagcacctaagatgaagccaacaagaggagccctggccaaatacgcaagacttgttggtgacgcatcacatggagcagttacagacttaggaggagatgcttactaa

SEQ ID NO: 55 - protein, 640 aa, Neurospora crassa
MASNQDNKAVAPDAAAPAGQSTTTTTTNDNSERNLPKEGEYIQWRTLPAGNPDQLNRWSHFLTREHEFPGAQAMLYGAGVPNKDMMKKAPHVGIATVWWEGNPCNTHLLDLGQKVKKAVEREKMLAWQFNTIGVSDGITMGGEGMRYSLQSREIIADSIETVTCAQHHDANISIPGCDKNMPGVIMAAARHNRPFVMIYGGTMRGGHSELLDRPINIVTCYEASGAYTYGRLKPACPNSTATPSDVMDDIEQHACPGAGACGGMYTANTMATAIEAMGLTAPGSSSFPASSPEKFRECEKAAEYIKICMEKDIRPRDLLTKASFENALVLTMILGGSTNGVLHYLAMANSADVDLTLDDINRVSAKTPFLADMAPSGRYYMEDLYKVGGTPAVLKMLIAAGYIDGTIPTITGKSLAENVSDWPSLDPDQKIIRPLDNPIKSQGHIRVLYGNFSPGGAVAKITGKEGLSFTGKARCFNKEFELDAALKNSEITLEQGNQVLIVRYEGPKGGPGMPEQLKASAAIMGAGLTNVALVTDGRYSGASHGFIVGHVVPEAATGGPIALVKDGDLITIDAVRNRIDVVKTVEGVEGEEEIAKVLEERKKGWKAPKMKPTRGALAKYARLVGDASHGAVTDLGGDAY

SEQ ID NO: 56 - DNA, 771 bp, Drosophila melanogaster
atgtcgtttactttgaccaacaagaacgtgattttcgttgccggtctgggaggcattggtctggacaccagcaaggagctgctcaagcgcgatctgaagaacctggtgatcctcgaccgcattgagaacccggctgccattgccgagctgaaggcaatcaatccaaaggtgaccgtcaccttctacccctatgatgtgaccgtgcccattgccgagaccaccaagctgctgaagaccatcttcgcccagctgaagaccgtcgatgtcctgatcaacggagctggtatcctggacgatcaccagatcgagcgcaccattgccgtcaactacactggcctggtcaacaccacgacggccattctggacttctgggacaagcgcaagggcggtcccggtggtatcatctgcaacattggatccgtcactggattcaatgccatctaccaggtgcccgtctactccggcaccaaggccgccgtggtcaacttcaccagctccctggcgaaactggcccccattaccggcgtgacggcttacactgtgaaccccggcatcacccgcaccaccctggtgcacacgttcaactcctggttggatgttgagcctcaggttgccgagaagctcctggctcatcccacccagccctcgttggcctgcgccgagaacttcgtcaaggctatcgagctgaaccagaacggagccatctggaaactggacttgggcaccctggaggccatccagtggaccaagcactgggactccggcatctaa

SEQ ID NO: 57 - protein, 256 aa, Drosophila melanogaster
MSFTLTNKNVIFVAGLGGIGLDTSKELLKRDLKNLVILDRIENPAAIAELKAINPKVTVTFYPYDVTVPIAETTKLLKTIFAQLKTVDVLINGAGILDDHQIERTIAVNYTGLVNTTTAILDFWDKRKGGPGGIICNIGSVTGFNAIYQVPVYSGTKAAVVNFTSSLAKLAPITGVTAYTVNPGITRTTLVHTFNSWLDVEPQVAEKLLAHPTQPSLACAENFVKAIELNQNGAIWKLDLGTLEAIQWTKHWDSGI

SEQ ID NO: 58 - DNA, 1023 bp, Lactococcus lactis
atgaaagcagcagtagtaagacacaatccagatggttatgcggaccttgttgaaaaggaacttcgagcaatcaaacctaatgaagctttgcttgacatggagtattgtggagtctgtcataccgatttgcacgttgcagcaggtgattatggcaacaaagcagggactgttcttggtcatgaaggaattggaattgtcaaagaaattggagctgatgtaagctcgcttcaagttggtgatcgggtttcagtggcttggttctttgaaggatgtggtcactgtgaatactgtgtatctggtaatgaaactttttgtcgagaagttaaaaatgcaggatattcagttgatggcggaatggctgaagaagcaattgttgttgccgattatgctgtcaaagttcctgacggacttgacccaattgaagctagctcaattacttgtgctggagtaacaacttacaaagcaatcaaagtatcaggagtaaaacctggtgattggcaagtaatttttggtgctggaggacttggaaatttagcaattcaatatgctaaaaatgtttttggagcaaaagtaattgctgttgatattaatcaagataaattaaatttagctaaaaaaattggagctgatgtgattatcaattctggtgatgtaaatccagttgatgaaattaaaaaaataactggcggcttaggggtgcaaagtgcaatagtttgtgctgttgcaaggattgcttttgaacaagcggttgcttctttgaaacctatgggcaaaatggttgctgtggcacttcccaatactgagatgactttatcagttccaacagttgtttttgacggagtggaggttgcaggttcacttgtcggaacaagacttgacttggcagaagcttttcaatttggagcagaaggtaaggtaaaaccaattgttgcgacacgcaaactggaagaaatcaatgatattattgatgaaatgaaggcaggaaaaattgaaggccgaatggtcattgattttactaaataa

SEQ ID NO: 59 - protein, 340 aa, Lactococcus lactis
MKAAVVRHNPDGYADLVEKELRAIKPNEALLDMEYCGVCHTDLHVAAGDYGNKAGTVLGHEGIGIVKEIGADVSSLQVGDRVSVAWFFEGCGHCEYCVSGNETFCREVKNAGYSVDGGMAEEAIVVADYAVKVPDGLDPIEASSITCAGVTTYKAIKVSGVKPGDWQVIFGAGGLGNLAIQYAKNVFGAKVIAVDINQDKLNLAKKIGADVIINSGDVNPVDEIKKITGGLGVQSAIVCAVARIAFEQAVASLKPMGKMVAVALPNTEMTLSVPTVVFDGVEVAGSLVGTRLDLAEAFQFGAEGKVKPIVATRKLEEINDIIDEMKAGKIEGRMVIDFTK

SEQ ID NO: 60 - DNA, 1023 bp, Lactococcus lactis
atgaaagcagcagtagtaagacacaatccagatggttatgcggaccttgttgaaaaggaacttcgagcaatcaaacctaatgaagctttgcttgacatggagtattgtggagtctgtcataccgatttgcacgttgcagcaggtgattttggcaacaaagcagggactgttcttggtcatgaaggaattggaattgtcaaagaaattggagctgatgtaagctcgcttcaagttggtgatcgggtttcagtggcttggttctttgaaggatgtggtcactgtgaatactgtgtatctggtaatgaaactttttgtcgagaagttaaaaatgcaggatattcagttgatggcggaatggctgaagaagcaattgttgttgccgattatgctgtcaaagttcctgacggacttgacccaattgaagctagctcaattacttgtgctggagtaacaacttacaaagcaatcaaagtatcaggagtaaaacctggtgattggcaagtaatttttggtgctggaggacttggaaatttagcaattcaatatgctaaaaatgtttttggagcaaaagtaattgctgttgatattaatcaagataaattaaatttagctaaaaaaattggagctgatgtgactatcaattctggtgatgtaaatccagttgatgaaattaaaaaaataactggcggcttaggggtgcaaagtgcaatagtttgtgctgttgcaaggattgcttttgaacaagcggttgcttctttgaaacctatgggcaaaatggttgctgtggcagttcccaatactgagatgactttatcagttccaacagttgtttttgacggagtggaggttgcaggttcacttgtcggaacaagacttgacttggcagaagcttttcaatttggagcagaaggtaaggtaaaaccaattgttgcgacacgcaaactggaagaaatcaatgatattattgatgaaatgaaggcaggaaaaattgaaggccgaatggtcattgattttactaaataa

SEQ ID NO: 61 - protein, 340 aa, Lactococcus lactis
MKAAVVRHNPDGYADLVEKELRAIKPNEALLDMEYCGVCHTDLHVAAGDFGNKAGTVLGHEGIGIVKEIGADVSSLQVGDRVSVAWFFEGCGHCEYCVSGNETFCREVKNAGYSVDGGMAEEAIVVADYAVKVPDGLDPIEASSITCAGVTTYKAIKVSGVKPGDWQVIFGAGGLGNLAIQYAKNVFGAKVIAVDINQDKLNLAKKIGADVTINSGDVNPVDEIKKITGGLGVQSAIVCAVARIAFEQAVASLKPMGKMVAVAVPNTEMTLSVPTVVFDGVEVAGSLVGTRLDLAEAFQFGAEGKVKPIVATRKLEEINDIIDEMKAGKIEGRMVIDFTK

SEQ ID NO: 62 - DNA, 4745 bp, Artificial Sequence
  Saccharomyces cerevisiae AFT1-1UP Integration Construct
cacattggccgttttaacgcaagttggcgtacttatattgactgttggatgaaagggtaatcaagagaaacggaaacggcctcctcatcgttaagctcatcagtattcatttctcccctttctgctccatcgcgtgctcgagactatattcttcagattatcaagcagaaacagaattcgcatattacataactttcacaggttgaagtataaaccgctacagtacacaacctcggatagaatatagggaagaggccaattccgtgaaaacgatttaatattctttacagttacaaaaagtattacctattatcctcttttcggtgtcattgacaaacctcttagcgacagaaactccctagcaaaagagtaaatccataggaacaacaaaagaagacaaattatcataatataattgggagtgatagacgacgattcatgctataccgtaggtttttgatacaagtctaacagttatactatttttaaaaacaaaaaaataacagaaaaatctacgacaatggaaggcttcaatccggctgacatagaacatgcgtcaccgattaattcatctgacagccattcatcctcctttgtatatgctctacccaaaagtgctagtgaatatgtagtcaaccataatgagggtcgtgcaagtgcaagtggaaatccagccgcagtgccgtctcccataatgacactgaatctcaaaagcacacattccctcaatattgatcagcatgttcatacctcaacatcgccgacggaaactattgggcatattcatcatgtggaaaagctgaatcaaaacaatttgattcatctggatccagtacccaactttgaagataagtccgatattaagccttggttgcaaaagattttttatcctcaaggaatagaacttgtgatagaaaggtcggacgcatttaaagttgtcttcaagtgtaaagctgctaaaaggggaaggaacgcgagaaggaaaagaaaagataagcccaaaggacaggaccacgaagacgagaaatccaagatcaatgatgacgaattagaatatgcgagtccttctaatgccacagtaaccaatgggcctcaaacatcgcccgatcaaacatcctccataaagccaaagaaaaaaagatgtgtatcgaggtttaataactgtccgtttagagtacgagctacttattcgttaaagaggaaaagatggagcattgttgtaatggacaataaccattcacatcagctaaagtttaaccctgattccgaagagtacaaaaaattcaaagaaaaattaagaaaggataatgacgtagatgcaatcaagaaattcgacgaattggaatacagaactttggccaatttgcccattccaacagctacaatcccctttgattgtggtttaacaaatgaaatacaaagtttcaatgtcgtattgcccactaacagtaatgttacttcatcagcatcctcttcaactgtatcgtccatatcccttgattcatcgaatgcatctaaaaggccatgcttaccctctgtaaataacaccggtagtatcaataccaataacgtaaggaaaccgaaaagccagtgtaagaataaagacacactcttaaaaagaaccaccatgcagaactttctcacaactaaatcaaggctgcgtaagaccggtacgccaacatcttcgcaacactcatctacagcattttcaggatatattgatgatcctttcaatttgaatgaaatcttgccactgccggcatccgatttcaagctaaacactgtaacaaatttgaacgaaattgactttacgaacatttttaccaaatcgccgcatccacatagcgggtctacccatccaagacaagtcttcgaccaattggacgattgttcctctatactcttctctccattaactacaaacacgaataatgaatttgaaggagagtcagatgattttgttcattctccatatttgaactcagaggcagatttcagccaaattcttagtagtgctcccccagtccatcatgacccaaatgaaacacatcaggaaaaccaggatattattgatagatttgctaatagttcccaagaacataatgagtatattctacaatatttgacgcactccgatgctgctaaccacaataacatcggcgttccaaacaacaattcacattcgctaaatactcagcataacgtttctgatctgggcaactcacttttaagacaagaagctttagttggcagctcttcaacaaaaatcttcgacgaattgaaatttgtacaaaatggcccacacggttctcaacatcctatagattttcaacatgttgaccatcgtcatctcagctctaatgaacctcaagtacgatcacatcaatatggtccgcaacagcagccaccgcagcaattgcaatatcaccaaaatcagccccacgacggccataaccacgaacagcaccaaacagtacaaaaggatatgcaaacgcatgaatcgctagaaataatgggaaacacattattggaagagttcaaagacattaaaatggtgaacggcgagttgaagtatgtgaagccagaagattaggccgctgcgggtatagaaagggttctttactctatagtacctcctcgctcagcatctgcttcttcccaaagatgaacgcggcgttatgtcactaacgacgtgcaccaacttgcggaaagtggaatcccgttccaaaactggcatccactaattgatacatctacacaccgcacgccttttttctgaagcccactttcgtggactttgccatatgcaaaattcatgaagtgtgataccaagtcagcatacacctcactagggtagtttctttggttgtattgatcatttggttcatcgtggttcattaattttttttctccattgctttctggctttgatcttactatcatttggatttttgtcgaaggttgtagaattgtatgtgacaagtggcaccaagcatatataaaaaaaaaaagcattatcttcctaccagagttgattgttaaaaacgtatttatagcaaacgcaattgtaattaattcttattttgtatcttttcttcccttgtctcaatcttttatttttattttatttttcttttcttagtttctttcataacaccaagcaactaatactataacatacaataatagatgggtaaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggagttcagcgagagcctgacctattgcatctcccgccgtgcacagggtgtcacgttgcaagacctgcctgaaaccgaactgcccgctgttctccagccggtcgcggaggccatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcatgcggatttcggctccaacaatgtcctgacggacaatggccgcataacagcggtcattgactggagcgaggcgatgttcggggattcccaatacgaggtcgccaacatcctcttctggaggccgtggttggcttgtatggagcagcagacgcgctacttcgagcggaggcatccggagcttgcaggatcgccgcgcctccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccgagggcaaaggaataacatatagatgaaatcaaacttagacgtatctctcgtccattttcattacattttcatctttcttcattaattatatactgaacatatacgcatctatacaattttgactttttaaagaagaaaaagaaaacaatagtatacattcttttttctacttttgttacagataaaaaatcgttcttattatattacatatatcggtgctaagatcaggattttttcatgttccttccccctgttatttcacatcatccttttgccggtagattaggctggtgtaaatagtagtgcttttctcatacatacaagacatacgtgaagataagtcccattttctctccctctgtcattaattttgaaagttcgttgagcactcatgaaaactgcgtccttttgtttttttgatctgaagtaaatatgtgtgagcaagataagcacacaaagaataaaaccatcgaagtatcctttcttctttgttgtgattgaaaaaacacattttcccgagagtgacatttgggacattctct

SEQ ID NO: 63 - DNA, 3794 bp, Artificial Sequence
  Saccharomyces cerevisiae AFT2-1UP Integration Construct
cttaaataaaggttaaggaaatgtaaataaaaaaaataacagtgacattaatttgtatatatctcaacttcttcactttaacctgtctgagctgtttggttttgaactggaagcacgtttctcattttattgaacgataccagagccattcattattcgattgacggtaagcggtattgtgcgaaaagcaaagggaaaaaatagaaagaacaaaaaaaagaaagaaaaaagcaccgtaaaaaaaaaaatcgtttcgtgggccgagatcggtaaagtggctttcttttagtcagaattgattttcttttgattaaggcaaaaactgtgcaaattaaactgatggacctatacataatagtgaacacgactcattcaaaaaatttgttgtagtgaccagaaactctggcgcaaattaatcaagagaaagcgacccccaagaaatgaaagcaaagtcgatgaagagcataatatctgtgccaatatcagtgtctaaaacagggaaaatgaagttaacagcatctcccgataatctagcatctatgatgtctaaagaccaaaataaacttattcatttagacccagttccgtcttttgaggacaggcacgagattaaaccgtggctacagaaaatattctatcctcaaggaatagatatagtcatcgaaagatcagatagtagcaaagttacttttaagtgtaggtcagtacgatcgaaagtagggttgaaccctaaatccaaaggttcctcttcaagatcccatgcatgtccatttagaattagagcagcctactctgtgcggttacagaagtggaacgtggttgttatgaataacatacattcacatgagctgagatttgatttgattactaaaacggatgactataaaaagtttaaggaaaatcttcgtcagaagaacgacgaaaaagccatcaaaacatttgatgaattagaatataaagcaagtctaaacttaccactcgtcacaccaattatttcttttgactgtgggttaaccaaggaaattgaagctttcaataacatttttctcccactatcaaacccccctttgacgtctaaaaaaaatttgctcaaaacaaataaaaactccgtttctaaaataaaatccagacagatggataattcgaaacctaggccaaggttgaaaacgaagttggatgcggatctacatgataccggatttttagacaatttcaaaacgcggaattcctgtgtaaagatagagaaagaagattctttaacgaacttaaacgaaattgattttacgaacatgttttgcaacgacaatttcatccaaaattacaaccaaggcctgatggaacttttgacagaacctacaccaggtccttcgtcctcttcttgtatacttccttcaacaccaacgaggcccttgtcacaaagcaaaatggatatagccctgtcagaatcaacaacatcttcaccaaattttatggaaacagacgctccttatggagatgagatcattaaagtttccaaagataccaaaagcaacgcaccaactgctgatacagatattgctacgaacttaggcaaagagagaaacgaaaattttggcatgttaaactacaactacgaagcgttgcttcatttcaacgatgagcattttaatgaattaaattctattgacccagccttaatatcaaaatattaagccgctgcgggtatagaaagggttctttactctatagtacctcctcgctcagcatctgcttcttcccaaagatgaacgcggcgttatgtcactaacgacgtgcaccaacttgcggaaagtggaatcccgttccaaaactggcatccactaattgatacatctacacaccgcacgccttttttctgaagcccactttcgtggactttgccatatgcaaaattcatgaagtgtgataccaagtcagcatacacctcactagggtagtttctttggttgtattgatcatttggttcatcgtggttcattaattttttttctccattgctttctggctttgatcttactatcatttggatttttgtcgaaggttgtagaattgtatgtgacaagtggcaccaagcatatataaaaaaaaaaagcattatcttcctaccagagttgattgttaaaaacgtatttatagcaaacgcaattgtaattaattcttattttgtatcttttcttcccttgtctcaatcttttatttttattttatttttcttttcttagtttctttcataacaccaagcaactaatactataacatacaataatagatgggtaaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggagttcagcgagagcctgacctattgcatctcccgccgtgcacagggtgtcacgttgcaagacctgcctgaaaccgaactgcccgctgttctccagccggtcgcggaggccatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcatgcggatttcggctccaacaatgtcctgacggacaatggccgcataacagcggtcattgactggagcgaggcgatgttcggggattcccaatacgaggtcgccaacatcctcttctggaggccgtggttggcttgtatggagcagcagacgcgctacttcgagcggaggcatccggagcttgcaggatcgccgcgcctccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccgagggcaaaggaataatatttagttttcaactcattaaaacggtatcacgtttaaatatgtgacaagatctgatggacatgaataatggtgatatcagcaccatcgagggattttggaccttagactttttaaagctacggaggacttaaagcatgtcgatacaaataagatatatcatggcttcatgcgctcaaaagttttattcttcaagtttgttgattataatatggttcacgtgcgcttcatcttttcataggtaatgcaccgcaacattcaattatctaaaaaactttcaggcgtgccggtcccctaatttttgcactgagatcatgagatcagtaagtaaaagctcatataggaaataatcatatagaaaaaagcagaggaatgatattcgaacattttctatacatcacccctcctatttttagatgaatctctaagatctaaatgccctcaacttaaatatgatattgaattaaaatgaattgta

SEQ ID NO: 64 - DNA, 26 bp, Artificial Sequence
  AFT1UP Forward Primer
ctcacttttaagacaagaagctttag

SEQ ID NO: 65 - DNA, 21 bp, Artificial Sequence
  pENO2 Reverse Primer
ttcatgaattttgcatatggc

SEQ ID NO: 66 - DNA, 22 bp, Artificial Sequence
  AFT1term Reverse Primer
ctgatcttagcaccgatatatg

SEQ ID NO: 67 - DNA, 20 bp, Artificial Sequence
  AFT1UpfullF Primer
tgacaaacctcttagcgaca

SEQ ID NO: 68 - DNA, 20 bp, Artificial Sequence
  AFT1UPsequence1 Primer
ggagtgatagacgacgattc

SEQ ID NO: 69 - DNA, 26 bp, Artificial Sequence
  AFT1UPsequence2 Primer
cactaacagtaatgttacttcatcag

SEQ ID NO: 70 - DNA, 20 bp, Artificial Sequence
  AFT2UP Forward Primer
cgaacttaggcaaagagaga

SEQ ID NO: 71 - DNA, 20 bp, Artificial Sequence
  AFT2term Reverse Primer
atgtccatcagatcttgtca

SEQ ID NO: 72 - DNA, 21 bp, Artificial Sequence
  AFT2UP full Forward
tgaacgataccagagccattc

SEQ ID NO: 73 - DNA, 23 bp, Artificial Sequence
  AFT2UP sequence 1
tttgttgtagtgaccagaaactc

SEQ ID NO: 74 - DNA, 19 bp, Artificial Sequence
  AFT2UP sequence 2
attcgaaacctaggccaag

SEQ ID NO: 75 - DNA, 22 bp, Artificial Sequence
  Primer 2649
tccaggcggtattgacagcagg

SEQ ID NO: 76 - DNA, 25 bp, Artificial Sequence
  Primer 2650
caatctgcaacatcaggtaccacgg

SEQ ID NO: 77 - DNA, 23 bp, Artificial Sequence
  Primer 2962
acgccaacatcttcgcaacactc

SEQ ID NO: 78 - DNA, 21 bp, Artificial Sequence
  Primer 2963
tgccggcagtggcaagatttc

SEQ ID NO: 79 - DNA, 25 bp, Artificial Sequence
  Primer 2966
cctcttcaagatcccatgcatgtcc

SEQ ID NO: 80 - DNA, 23 bp, Artificial Sequence
  Primer 2967
tgtaaccgcacagagtaggctgc

SEQ ID NO: 81 - DNA, 21 bp, Artificial Sequence
  Primer 2972
tggccactgaaggtaacgccg

SEQ ID NO: 82 - DNA, 23 bp, Artificial Sequence
  Primer 2973
ccggtaggaatgaaggcatgctg

SEQ ID NO: 83 - DNA, 21 bp, Artificial Sequence
  Primer 2976
tggcgctgagattgtggtcgg

SEQ ID NO: 84 - DNA, 20 bp, Artificial Sequence
  Primer 2977
tgaagcgtgcactagcgtcc

SEQ ID NO: 85 - DNA, 22 bp, Artificial Sequence
  Primer 2978
tgccgggcaaatcgtttctgag

SEQ ID NO: 86 - DNA, 25 bp, Artificial Sequence
  Primer 2979
cttgtggcccaaggtggtaaagacc

SEQ ID NO: 87 - DNA, 615 bp, Saccharomyces cerevisiae
atgaaattctcttccgctttggttctatctgctgttgccgctactgctcttgctgagagtatcaccaccaccatcactgccaccaagaacggtcatgtctacactaagactgtcacccaagatgctacttttgtttggggtggtgaagactcttacgccagcagcacttctgccgctgaatcttctgccgccgaaacttctgccgccgaaacctctgctgccgctaccacttctgctgccgctaccacttctgctgctgagacttcttctgctgctgagacttcttctgctgatgaaggttctggttctagtatcactaccactatcactgccaccaagaacggtcacgtctacactaagactgtcacccaagatgctacttttgtctggactggtgaaggcagcagcaacacctggtctccaagtagtacttctaccagctcagaagctgctacctcttctgcttcaaccactgcaaccaccactgctgaaacttcttcctctgctacatcctctagcaccgctgaattatctagttacaccggtgctgctgatgccatcaccgctggtactggtttgatgggtgctgcccttgctgccgtcatgttattgtaa

SEQ ID NO: 88 - protein, 204 aa, Saccharomyces cerevisiae
MKFSSALVLSAVAATALAESITTTITATKNGHVYTKTVTQDATFVWGGEDSYASSTSAAESSAAETSAAETSAAATTSAAATTSAAETSSAAETSSADEGSGSSITTTITATKNGHVYTKTVTQDATFVWTGEGSSNTWSPSSTSTSSEAATSSASTTATTTAETSSSATSSSTAELSSYTGAADAITAGTGLMGAALAAVMLL

SEQ ID NO: 89 - DNA, 1587 bp, Saccharomyces cerevisiae
atgaaattgtcttccgcttttgtattatctgctatcaccgttgccgctttaggcgaaagtattactactacgataactgctaccaaaaatgggcatgtttacaccaagactgtcactcaagatgctacttttgtctgggcaggagaaggcgctgcggtaacctccgcagtaactgaagcgtctactgtcgctgcaacgtctgctgccgctgaaacatctgttgccgctgaaacatctattgttgagccttccacttctgctcagggcacctctgctgatgaagggtctggttcgagtataaccaccactattacagccaccaaaaatggacatgtctacacaaagaccgtcacccaggatgctactttcgtatggactggagagggtgaacgtgctcctgcctcaactgttgctactgtcgaaacatctgttgccgctgaaacatctgttgctgaaccttctacctctgctcagggcacctctgctgatgaagggtctggttcgagtataaccaccactattacagccaccaaaaatggacatgtctacacaaagaccgtcacccaggacgctactttcgtatggactggtgagggtgaacgtgctcctgtctcaaccgttgctactgtcgaaacagctgcttctccagtaacatctgttgctgaaccttctgcctctactgatgaaggatctggttcgagtataactaccactattacagccaccaaaaatggacatgtctacacaaagaccgtcacccaggacgctactttcgtatggactggtgagggtgaacgcgctcctgcctccaccgttgcaacttctagtatttctgctattgaaattccctccactactgaggcctctattgtggaggcttcttctgctgttgagacttcctctgctgctgagacttcctctgctgttgagacttcctctgctgttgagacttcctctgctgttgagacttcttctgctgctgagacttcctctgctgctgagacttcctctgccgttgagacttcctctgctgttgagatttcttctgctgttgagacttctgctgttgagacttcttcttcttcctctactatcgagaccacttctgttaaaagcttatctcctactcagacttctctttcatcttctgtccaggcttcttctcctattgagacttcttctgctgcaaaaacctcttctgttgtgccaactttttcttctactactactgaaaattcctctaattctaaatccacgtctgcagttgtagcatctactaccacctcctctgagtcaagcgctactattgttactcctactagaattgggcaagcttacacagagagttcttctagggatgcccaatctgttcgtacccatgaaagtaacaattggtcatcaagttcttctgcaagcacaaaaatggtatcctctattacaagagttcaaaccactaccgctggtattttcactaacggtaagtcgtccacaactcctcaaatcgtgaattacacgggtgcggctgattctatcgccgctggtacgggtctgatgggcgctgcgctcgctgccgttatctttttgtaa

SEQ ID NO: 90 - protein, 528 aa, Saccharomyces cerevisiae
MKLSSAFVLSAITVAALGESITTTITATKNGHVYTKTVTQDATFVWAGEGAAVTSAVTEASTVAATSAAAETSVAAETSIVEPSTSAQGTSADEGSGSSITTTITATKNGHVYTKTVTQDATFVWTGEGERAPASTVATVETSVAAETSVAEPSTSAQGTSADEGSGSSITTTITATKNGHVYTKTVTQDATFVWTGEGERAPVSTVATVETAASPVTSVAEPSASTDEGSGSSITTTITATKNGHVYTKTVTQDATFVWTGEGERAPASTVATSSISAIEIPSTTEASIVEASSAVETSSAAETSSAVETSSAVETSSAVETSSAAETSSAAETSSAVETSSAVEISSAVETSAVETSSSSSTIETTSVKSLSPTQTSLSSSVQASSPIETSSAAKTSSVVPTFSSTTTENSSNSKSTSAVVASTTTSSESSATIVTPTRIGQAYTESSSRDAQSVRTHESNNWSSSSSASTKMVSSITRVQTTTAGIFTNGKSSTTPQIVNYTGAADSIAAGTGLMGAALAAVIFL

SEQ ID NO: 91 - DNA, 1911 bp, Saccharomyces cerevisiae
atgactaacgctttgctctctatagccgttttgcttttctcgatgctctcgctagcacaagcggagacgcacacgtttaattggaccactggctgggactacaggaacgttgatgggctaaagagccgtcccgtgatcacctgtaatggccagttcccatggccagatataacggtcaacaaaggtgaccgtgtgcagatttacttgaccaacggaatgaacaacaccaatacttctatgcatttccacggtctcttccaaaacggaaccgcctctatggacggtgtgcccttcttgacgcaatgtccaattgcgccaggcagtactatgctttacaatttcacggtggactacaatgtaggcacctactggtaccattcacacacggacggtcaatatgaagacgggatgaaaggtcttttcatcatcaaggatgatagcttcccctacgattacgatgaggaactttctttatcgcttagtgagtggtaccacgacttggtcacggacttgacgaagtcgttcatgagtgtttataatccgacaggtgctgagcccatcccacagaacttgattgttaacaacacgatgaatctgacatgggaagtccagcccgatacgacgtatcttttgagaattgtcaacgtgggtgggttcgtttcgcagtacttttggatcgaggaccacgaaatgaccgtggtcgaaatcgacggtatcactaccgagaagaacgtaacggatatgctttacatcactgtcgctcagagatatacagtcctggttcacactaaaaacgacacggacaaaaatttcgccatcatgcagaaatttgatgacaccatgttggatgtcattccaagtgatttacagctgaatgcaacctcttatatggtctacaacaaaaccgctgcgctgcccacacaaaattacgtggattcaattgataacttcttggacgatttctacttgcaaccgtacgagaaagaagccatctatggcgagccagatcatgtgattaccgttgacgttgttatggataacttgaaaaacggtgtgaattacgccttcttcaataatatcacctatactgcaccaaaagttcctactttgatgaccgttttgtcttcaggtgatcaagcaaacaactccgaaatctacggttcaaacacgcacactttcatcctagagaaggatgaaatcgtggagattgtgctaaataaccaggacacaggtacccatcctttccatttacatggtcacgctttccaaaccatccagagagatcgtacatatgatgatgccctaggtgaagttcctcacagtttcgatccggacaaccaccctgccttcccagaatacccaatgagaagagatactttatacgttagaccacaatccaatttcgtcatcaggtttaaagccgataacccaggtgtttggttcttccattgtcatatcgaatggcatttgttgcaaggtttgggtcttgttctcgtggaggatccttttggtatccaagatgctcattctcaacaactcagtgaaaaccacttagaagtttgccagagttgctctgtggccactgaaggtaacgccgctgccaatacactggatttaactgatttaactggtgaaaatgttcagcatgccttcattcctaccggttttaccaaaaaaggtattattgccatgacattctcctgctttgccggtattcttggtattatcacaattgcaatttatggtatgatggatatggaagatgcgaccgaaaaggttattcgagacttgcacgtggaccctgaagtcttgctaaatgaggttgatgaaaatgaagagcgtcaggtaaacgaagatcgtcattccactgaaaagcatcaatttttaactaaagccaaacggttcttctaa

SEQ ID NO: 92 - protein, 635 aa, Saccharomyces cerevisiae
MTNALLSIAVLLFSMLSLAQAETHTFNWTTGWDYRNVDGLKSRPVITCNGQFPWPDITVNKGDRVQIYLTNGMNNTNTSMHFHGLFQNGTASMDGVPFLTQCPIAPGSTMLYNFTVDYNVGTYWYHSHTDGQYEDGMKGLFIIKDDSFPYDYDEELSLSLSEWYHDLVTDLTKSFMSVYNPTGAEPIPQNLIVNNTMNLTWEVQPDTTYLLRIVNVGGFVSQYFWIEDHEMTVVEIDGITTEKNVTDMLYITVAQRYTVLVHTKNDTDKNFAIMQKFDDTMLDVIPSDLQLNATSYMVYNKTAALPTQNYVDSIDNFLDDFYLQPYEKEAIYGEPDHVITVDVVMDNLKNGVNYAFFNNITYTAPKVPTLMTVLSSGDQANNSEIYGSNTHTFILEKDEIVEIVLNNQDTGTHPFHLHGHAFQTIQRDRTYDDALGEVPHSFDPDNHPAFPEYPMRRDTLYVRPQSNFVIRFKADNPGVWFFHCHIEWHLLQGLGLVLVEDPFGIQDAHSQQLSENHLEVCQSCSVATEGNAAANTLDLDLTGENVQHAFIPTGFTKKGIIAMTFSCFAGILGIITIAIYGMMDMEDATEKVIRDLHVDPEVLLNEVDENEERQVNEDRHSTEKHQFLTKAKRFF

SEQ ID NO: 93 - DNA, 2061 bp, Saccharomyces cerevisiae
atggttagaacccgtgtattattctgcttatttatatctttttttgctacggttcaatcgagtgctacacttattagcacttcatgtatttcccaagctgcgctataccaatttggatgttctagtaaatctaaaagttgctactgtaaaaacatcaattggctgggttcagtgacagcatgtgcctatgagaattccaaatctaacaaaacactagacagcgccttaatgaagttagcatcccaatgttcaagcatcaaagtttatactttagaggacatgaagaatatttatttaaatgcgtcaaattatttgagagcacctgagaaaagtgataaaaaaaccgtggttagtcaaccgctcatggcgaacgagacagcgtatcattattattatgaggaaaattatggtatccatcttaacctaatgcgctctcaatggtgcgcttggggtctcgtcttcttctgggtggctgtgcttactgcagccactatcttgaacattctgaaaagggtgtttggtaagaacatcatggcaaactccgtcaaaaaatcacttatttatccttctgtttacaaagattataatgaacgaactttttatttatggaagcgtctaccatttaattttacaactcgaggcaagggtctcgtcgtattaatttttgttattttgactatattatctctcagttttggtcataatattaaacttccacacccatatgataggcccagatggagaagaagtatggcctttgtgagtcgtagagcagacttgatggccattgcacttttcccagtagtctatctattcggaataagaaataatcccttcatccctataacagggctttccttttctacatttaatttctatcataaatggtctgcctacgtttgtttcatgttggccgttgtacactcaattgtcatgaccgcctcgggagtgaaaagaggtgtgtttcaaagtctggttaggaaattttactttaggtggggtatagtggcaacgatattaatgtctattattattttccaaagtgaaaaagtatttagaaatagagggtatgagatattccttcttattcataaagcgatgaatattatgttcattattgccatgtactaccattgtcacaccctgggctggatgggttggatttggtcaatggctggtattttatgctttgatagattctgcaggattgttagaataatcatgaatggtggcttgaaaactgctactttgagtaccactgatgattctaatgttattaaaatttcagtaaaaaaaccaaagtttttcaagtaccaagtaggagctttcgcatacatgtatttcttatcaccaaaaagtgcatggttctatagtttccaatcacatccatttacagtattatcggaacgacaccgtgatccaaacaatccagatcaattgacgatgtacgtaaaggcaaataaaggtatcactcgagttttgttatcgaaagttctaagtgctccaaatcatactgttgattgtaaaatattccttgaaggcccatatggtgtaacggttccacatatcgctaagctaaaaagaaatctggtaggtgtagccgctggtttgggtgttgcggctatttatccgcactttgtcgaatgtttacggttaccatctactgatcaacttcagcataaattttactggattgttaatgacctatcccatttgaaatggtttgaaaatgaattgcaatggttaaaggagaaaagttgtgaagtctcagtcatatatactggttccagtgttgaggacacaaattcagatgagagtacaaaaggttttgatgataaagaagaaagcgaaatcactgttgaatgtctcaataaaagacctgatttgaaagaactagtgcgctcggaaataaaactctcagaactagagaataataatattaccttttattcctgcgggccagcaacgtttaacgacgattttagaaatgcagtggtccaaggtatagactcttccttgaagattgacgttgaactagaagaagaaagttttacatggtaa

SEQ ID NO: 94 - protein, 686 aa, Saccharomyces cerevisiae
MVRTRVLFCLFISFFATVQSSATLISTSCISQAALYQFGCSSKSKSCYCKNINWLGSVTACAYENSKSNKTLDSALMKLASQCSSIKVYTLEDMKNIYLNASNYLRAPEKSDKKTVVSQPLMANETAYHYYYEENYGIHLNLMRSQWCAWGLVFFWVAVLTAATILNILKRVFGKNIMANSVKKSLIYPSVYKDYNERTFYLWKRLPFNFTTRGKGLVVLIFVILTILSLSFGHNIKLPHPYDRPRWRRSMAFVSRRADLMAIALFPVVYLFGIRNNPFIPITGLSFSTFNFYHKWSAYVCFMLAVVHSIVMTASGVKRGVFQSLVRKFYFRWGIVATILMSIIIFQSEKVFRNRGYEIFLLIHKAMNIMFIIAMYYHCHTLGWMGWIWSMAGILCFDRFCRIVRIIMNGGLKTATLSTTDDSNVIKISVKKPKFFKYQVGAFAYMYFLSPKSAWFYSFQSHPFTVLSERHRDPNNPDQLTMYVKANKGITRVLLSKVLSAPNHTVDCKIFLEGPYGVTVPHIAKLKRNLVGVAAGLGVAAIYPHFVECLRLPSTDQLQHKFYWIVNDLSHLKWFENELQWLKEKSCEVSVIYTGSSVEDTNSDESTKGFDDKEESEITVECLNKRPDLKELVRSEIKLSELENNNITFYSCGPATFNDDFRNAVVQGIDSSLKIDVELEEESFTW

SEQ ID NO: 95 - DNA, 1215 bp, Saccharomyces cerevisiae
atgcctaacaaagtgtttaacgtggccgttttcttcgttgtgttcagagagtgcttggaagcagtgattgttatttccgtgctgctatcgtttttgaaacaggcaatcggggaacatgaccgggcgctgtaccgtaaattaaggattcaggtttgggtcggtgtgttactcgggttcatcatttgtctggccatcggtgcaggtttcatcggtgcgtactattcgctgcagaaggatattttcggaagcgcggaagacttgtgggaaggtatcttttgtatgattgcgacgataatgatctcgatgatgggtattcctatgttgagaatgaataagatgcagagtaagtggagagtgaagattgcgcggtcgttggtggagattcctcaccgtaagagagactatttcaagattgggttcttgagtagaagatatgctatgttccttttgccgtttattactgtcttgagagaaggtttggaagctgttgtgttcgttgccggtgcaggtattaccacacagggctcgcacgcctctgcttacccattgcccgttgtggttggtttgatatgtggtggtcttgttgggtatttgttgtactatggtgcttcgaaatcctcgctgcagattttcttgattttgtctacttcgatcttgtacctgatctccgccggtcttttctctcgtggtgcgtggtactttgaaaattacagattcaaccttgccagtggtggtgatgcttccgaaggcggtgatggtaatgggtcttataacatcagaaaggccgtttaccatgtcaattgttgcaacccagaactggacaatgggtgggatatcttcaatgctttgcttggatggcagaacaccggctacttgtcatccatgctttgttacaacatctattggttggttcttatcattgtgttgagtttaatgatattcgaagaaaggcgtggtcacttgcctttcaccaaaaacttacaattgaaacacttgaacccaggatactggatcaagaacaagaaaaagcaggagttgacggaagagcaaaagagacaactgtttgccaagatggagaacatcaacttcaatgaagatggtgagatcaatgtgcaagagaactacgaacttcccgagcaaactaccagtcattcctcgtctcaaaacgtcgccacagacaaggaagtcctccacgttaaagccgactctctttga

SEQ ID NO: 96 - protein, 404 aa, Saccharomyces cerevisiae
MPNKVFNVAVFFVVFRECLEAVIVISVLLSFLKQAIGEHDRALYRKLRIQVWVGVLLGFIICLAIGAGFIGAYYSLQKDIFGSAEDLWEGIFCMIATIMISMMGIPMLRMNKMQSKWRVKIARSLVEIPHRKRDYFKIGFLSRRYAMFLLPFITVLREGLEAVVFVAGAGITTQGSHASAYPLPVVVGLICGGLVGYLLYYGASKSSLQIFLILSTSILYLISAGLFSRGAWYFENYRFNLASGGDASEGGDGNGSYNIRKAVYHVNCCNPELDNGWDIFNALLGWQNTGYLSSMLCYNIYWLVLIIVLSLMIFEERRGHLPFTKNLQLKHLNPGYWIKNKKKQELTEEQKRQLFAKMENINFNEDGEINVQENYELPEQTTSHSSSQNVATDKEVLHVKADSL

SEQ ID NO: 97 - DNA, 462 bp, Saccharomyces cerevisiae
atgaaattctcaactattttcggagctactacagttatgactgccgtctcggcagcagctgtgtcgagtgtaatgaccactaagactattactgctactaacggtaataacgtttacactaaggtcgttaccgacaccgctgaccctatcattagttacagtaccactagaactgtcgttgtcagtaatagtgatgctacttacacaaaggttgtcaccgaaggaccagataccacctctgaaaagagtacaacaaagacacttactttgacaaacggttcaggttcatcaaccaacctttacaccaagaccgtcactcaagccgtcgaatcatctacatcctcctcatcctcctcatcctcctcctcctcttctgcctcttcttctggtgctgctcctgctgcattccaaggagcaagtgtcggtgcattggcccttggtttgatttcttacctattataa

SEQ ID NO: 98 - protein, 153 aa, Saccharomyces cerevisiae
MKFSTIFGATTVMTAVSAAAVSSVMTTKTITATNGNNVYTKVVTDTADPIISYSTTRTVVVSNSDATYTKVVTEGPDTTSEKSTTKTLTLTNGSGSSTNLYTKTVTQAVESSTSSSSSSSSSSSSASSSGAAPAAFQGASVGALALGLISYLL

SEQ ID NO: 99 - DNA, 1320 bp, Saccharomyces cerevisiae
atgaaactcggaagcaaacaggtaaaaattatatccttgttgctgctagacacagtgttcttcgggatcgagataactaccgggtacttgtctcactctttggctctaatcgcggactcattccatatgctaaacgatataatttctcttgtggttgcactttgggccgtaaatgttgccaaaaacagaaatccggattcaacgtacacttatggttggaaaagggcggagattttgggtgctctgattaacgccgtctttttgattgccttatgtgtctcaattttgatagaagcgctacaaagaattattgctccccccgtgattgaaaatcctaagtttgtgttgtatgtgggtgtcgcagggttgatatcgaacaccgttggacttttcttatttcacgacaatgatcaagagcatggacatggacacggacattcccatggcggtatctttgccgaccatgagatgcatatgccatcatcccacacacatacacatgcccatgttgatggaatagagaatactacaccaatggatagtacggataacattagtgagattatgcctaatgctatagtagatagttttatgaacgaaaatactagattattgacaccggaaaatgcatccaagacgccatcatactcaacgtcaagccatacgattgccagcggcggaaattacacagaacacaacaagcgcaagagatctttaaatatgcatggtgtgtttcttcacgttttgggcgatgctcttggcaacatcggcgttatgttgtctgcatttttcatttggaagaccgactattcttggaagtattatacagatccgcttgtctcattgataattaccggtataattttttcctctgcgcttcctctatcgtgcaaggcttccaaaatattgttacaagcgacaccttccactttatccggcgatcaagtagaaggtgatcttttgaaaataccaggaataatagctattcatgatttccatatttggaatttaacagagtctatttttattgcatctttgcatattcaactagatatcagcccggaacaatttactgacctggccaaaatagttagatcaaaacttcaccgctatggcattcactccgctactttgcaacctgaatttattaccagagaggttacttcaaccgaaagagccggagactcccaaggtgatcatctacaaaatgacccgctttcattaaggccaaagacatatggtactggcatttcaggttccacttgtcttatcgacgacgctgccaactgcaacacagctgattgcttagaggatcattaa

SEQ ID NO: 100 - protein, 439 aa, Saccharomyces cerevisiae
MKLGSKQVKIISLLLLDTVFFGIEITTGYLSHSLALIADSFHMLNDIISLVVALWAVNVAKNRNPDSTYTYGWKRAEILGALINAVFLIALCVSILIEALQRIIAPPVIENPKFVLYVGVAGLISNTVGLFLFHDNDQEHGHGHGHSHGGIFADHEMHMPSSHTHTHAHVDGIENTTPMDSTDNISEIMPNAIVDSFMNENTRLLTPENASKTPSYSTSSHTIASGGNYTEHNKRKRSLNMHGVFLHVLGDALGNIGVMLSAFFIWKTDYSWKYYTDPLVSLIITGIIFSSALPLSCKASKILLQATPSTLSGDQVEGDLLKIPGIIAIHDFHIWNLTESIFIASLHIQLDISPEQFTDLAKIVRSKLHRYGIHSATLQPEFITREVTSTERAGDSQGDHLQNDPLSLRPKTYGTGISGSTCLIDDAANCNTADCLEDH

SEQ ID NO: 101 - DNA, 1203 bp, Saccharomyces cerevisiae
atgccatttgtaaaaggttttgagccgatctccctaagagacacaaacctttttgaaccaattaagattggtaacactcagcttgcacatcgtgcggttatgcccccattgaccagaatgagggccactcaccccggaaatattccaaataaggagtgggctgctgtgtattatggtcagcgtgctcaaagacctggtaccatgatcatcacggaaggtacgtttatttcccctcaagccggcggctatgacaacgcccctgggatttggtctgatgagcaggtcgctgagtggaagaatatctttttagccatccatgattgtcagtcgttcgcgtgggtacaactttggtctttaggctgggcatccttcccagacgtattggcaagagacgggttacgctatgactgtgcatctgacagagtgtatatgaatgctacgttacaagaaaaggccaaagatgcgaataatctcgaacatagtttgactaaagacgacattaaacagtatatcaaggattacatccatgcggctaagaattctatcgcggctggcgccgatggtgtagaaattcatagcgccaatgggtacttgttgaatcagttcttggatccacattctaataagaggaccgacgaatacggcggaacgatcgaaaacagggcccgctttacactggaggttgtcgatgctcttatcgaaactatcggtcctgaacgggtgggtttgaggttgtcgccgtacggcacttttaacagtatgtctgggggtgctgaaccaggtattatcgctcaatattcgtatgttttgggtgaattagagaagagggcaaaggctggtaagcgtttggcctttgtgcacctcgttgaaccacgtgtcacggacccatcgttggtggagggcgaaggagaatattccgagggtactaacgattttgcctactctatatggaagggtccaatcatcagagctggtaattacgctcttcatccagaagtggttagagaacaagtaaaggatcccagaaccttgataggctatggtagattcttcatctctaacccagatttagtctaccgtttagaagagggcctgccattgaacaagtatgacagaagtaccttctacaccatgtccgcggaaggttataccgactacccaacatatgaagaggcagtagatttaggttggaacaagaactga

SEQ ID NO: 102 - protein, 400 aa, Saccharomyces cerevisiae
MPFVKGFEPISLRDTNLFEPIKIGNTQLAHRAVMPPLTRMRATHPGNIPNKEWAAVYYGQRAQRPGTMIITEGTFISPQAGGYDNAPGIWSDEQVAEWKNIFLAIHDCQSFAWVQLWSLGWASFPDVLARDGLRYDCASDRVYMNATLQEKAKDANNLEHSLTKDDIKQYIKDYIHAAKNSIAAGADGVEIHSANGYLLNQFLDPHSNKRTDEYGGTIENRARFTLEVVDALIETIGPERVGLRLSPYGTFNSMSGGAEPGIIAQYSYVLGELEKRAKAGKRLAFVHLVEPRVTDPSLVEGEGEYSEGTNDFAYSIWKGPIIRAGNYALHPEVVREQVKDPRTLIGYGRFFISNPDLVYRLEEGLPLNKYDRSTFYTMSAEGYTDYPTYEEAVDLGWNKN

SEQ ID NO: 103 - DNA, 858 bp, Saccharomyces cerevisiae
atgtgggctcaattatcatatactagaccagaatctcagaagactgacttaacgtcgttgttttccacagatcaagagcaaaatccattaaatgactaccagtaccagatcaatattagggaactggaggagtattacaacaagacgattttaaacgaggataacatacaggaaacaagcagtgaaatatcttcggcagtttcattctctccaccaaaaaatacaaacgctattcaaccggggctactgtatgatccacagttaatgaacccttttctcccatccgctcacctgaatagcacggcacctactacttttaaaaagaaactagaggtacaaataaatccggactatgtcccaaaatcttcacaattaccattaacttcacagaatttgcaacagttgtctcaacaaaagcccaaaaatgatgcttctttttcatcagagaaggaatcctcagctcaacctaaggtgaaaagccaagtgcaggaaactcccaaacaattatacaagacagagctgtgcgaatcattcactttaaaaggaagttgcccttatggcagtaagtgtcagtttgctcacggactcggcgaattaaaggttaagaaatcgtgcaagaatttcaggacgaagccctgtgtgaattgggagaaactaggttattgtccttatggcagaagatgctgcttcaaacatggcgacgacaacgacattgctgtttacgtgaaagctggtacttactgtaacgtctcttcgactagcaaacaatcagacgaaaagagaagcaatggtcgcggctccgccaagaagaagaatctaaatgttaaagtaaaggctttgcagagaatgacctggtga

SEQ ID NO: 104 - protein, 285 aa, Saccharomyces cerevisiae
MWAQLSYTRPESQKTDLTSLFSTDQEQNPLNDYQYQINIRELEEYYNKTILNEDNIQETSSEISSAVSFSPPKNTNAIQPGLLYDPQLMNPFLPSAHLNSTAPTTFKKKLEVQINPDYVPKSSQLPLTSQNLQQLSQQKPKNDASFSSEKESSAQPKVKSQVQETPKQLYKTELCESFTLKGSCPYGSKCQFAHGLGELKVKKSCKNFRTKPCVNWEKLGYCPYGRRCCFKHGDDNDIAVYVKAGTYCNVSSTSKQSDEKRSNGRGSAKKKNLNVKVKALQRMTW

SEQ ID NO: 105 - DNA, 4779 bp, Saccharomyces cerevisiae
atgggaacggatccccttattatccgaaataatggttcattttgggaagttgatgattttactcgtttaggaagaactcagctattgagctactatttaccattggctatcatagcctcaattggcattttcgcactttgtcgcagtggattatctcgttatgtaagatctgccgagtgcgatttagtgaacgaatatctatttggcgcacaagaagagagaaaagaagataatagtatagaaagacttctacggaactcaaatacccaagccaattacgtcaacgtcaaaaagcaaggaaggattttgaaacttagacattttgatataacaactatagatgtcaagcaaatcgatgctaaaaatcatggtggactaacgtttagtagaccgtctactagtgaccacttaagaaaatcatctgaaattgtattaatgtctttacaaataattggcctttcctttttaagagtaacaaaaatcaatattgaattaacgaacagagatgttacaactttactattattttggttaatactactttccctaagtatcttaagagtttacaagcgttcaacgaatctttgggccatctgttttactgcccatacaactatttggatttcaacctggattccaattcgttcggtctatattggtaatatcgatgatgtaccctcacagatattttacatctttgaattcgtaattacttcaaccttacagccaataaagctcacttcaccgattaaagacaactcatccatcatctacgttagagacgaccatacgtctccttcgagggaacacatatcctcaattttaagttgcattacttggagctggattaccaattttatatgggaggcccaaaagaacactattaagttaaaggatatttggggcttatcaatggaagactatagcattttcattctaaaagggtttaccaggagaaacaagcacattaataatttgacgctagcactgtttgaatctttcaaaacatatttactcataggaatgttatgggttctggtgaacagtattgtaaaccttcttcccacaattttaatgaaaagatttttagaaattgtggataacccaaaccgttcctcatcatgcatgaatttggcgtggctttatattattggtatgttcatttgtagattgacattagcaatttgtaattcccaaggtcaatttgtttctgataagatttgtttaagaataagagccatactcataggagaaatttatgcaaaaggcttacgtaggaggctgtttacatctccaaaaaccagctctgattcagatagtatctccgcaaaccttggtaccataattaatctcatttctattgactcatttaaggtatcggaactagcaaactacctttatgtgacagttcaggcagtaattatgataatagttgttgtaggactacttttcaactttttaggtgtttcagcttttgcaggaatttcaattatcttagtgatgttcccattgaatttcttgttagcgaatttgttaggtaagtttcaaaagcaaacactgaaatgtactgaccaaagaatctcaaaattgaacgagtgcttacagaacataagaattgtcaaatattttgcttgggaaaggaatattataaatgaaatcaaatcaataaggcaaaaggaattaagatccttattaaaaaaatctttggtgtggtccgtaacttcttttctttggttcgtgacaccgaccttggtgacaggtgtcactttcgccatctgtacatttgttcaacatgaagatttgaatgccccgcttgctttcactactttgtcactcttcactttgttaaagacacccctggatcaattatcaaatatgctaagtttcataaatcaatcaaaagtctctctaaaaagaataagcgattttttaaggatggacgatacagaaaaatataatcaactaaccatatctccagacaaaaataaaattgaatttaaaaatgcgactttaacctggaatgaaaatgacagcgatatgaatgcattcaaattatgtggtttgaatattaaatttcaaattggtaagttaaatttgattttgggttctacaggatctggtaaaagtgcattgctgctgggtttactgggtgaactaaatctaattagtggctctatcattgttccgagcttagaaccaaagcatgatttaattcccgactgcgaaggtttaaccaattccttcgcatattgttcacaaagtgcgtggctattaaatgacacggtaaaaaacaatattatctttgataacttctataacgaggataggtacaacaaagtaattgatgcatgtgggctgaaaagagacctggagattttaccagcaggtgacctaacagaaattggtgaaaagggtataactttatcaggagggcagaaacagagaatttccttggcgagagctgtttattcgagtgctaagcatgtcttactagatgattgtttgagcgctgtcgattcacatactgctgtatggatctatgaaaattgcatcacaggtccactaatgaaaaatagaacctgcattttagttacgcacaatgtttcattaacacttagaaatgcccatttcgcgattgtgttggaaaatggcaaagtgaagaatcaaggaactattacagaattacaaagcaaagggctttttaaggaaaaatatgttcaactttcttctcgagatagcattaatgaaaagaacgctaatagattaaaagctcccagaaaaaatgactctcagaaaatcgaacctgtcaccgagaacataaattttgatgcaaattttgtcaatgatggccagctaatagaagaggaagaaaaatcaaacggtgccataagccccgatgtttataaatggtacctgaaattttttggaggcttcaaagctttaacagccctgttcgctctttatatcacagctcaaattttgttcatcagtcagtcttggtggatacgacattgggtcaacgataccaatgtacgaataaatgctccaggttttgcgatggacacgctgccattaaaagggatgaccgactcttcgaaaaataaacataatgcattttattacttaaccgtatattttcttattggtatcattcaggcaatgctaggtggttttaaaacaatgatgacgtttttatccggtatgcgagcctccagaaagatctttaataatctgctagatctagttctacatgcccaaatacgatttttcgacgtgacgccggttggtagaatcatgaatcgcttttcaaaggacatcgaaggtgttgatcaagaattgattccatacttagaagtaactatattttgcctaattcaatgcgcatcaattatatttctcattaccgtaataactcctcgctttttgacagtcgccgttatcgtttttgttttatatttctttgtggggaaatggtacttaacggcaagtagagaattgaaaaggttagattcaataaccaaatcacccatttttcaacatttctcagagaccttggtaggcgtttgcacaattcgtgcatttggcgacgagaggagattcattttagaaaatatgaacaaaattgaccaaaataacagagcattcttttatttatcagttactgtcaaatggttttcttttagagtcgacatgattggcgcattcattgttttagcatcaggttcttttattctgctcaatattgcaaatattgactcgggtcttgccggcatttctttgacatatgccattttgtttacagatggtgctttatggttagttagactgtactcaacatttgaaatgaacatgaactctgttgaaagactaaaagaatattctagcattgaacaagagaactatcttggccatgatgaaggccgcattctacttctaaacgaaccatcgtggccaaaagatggagaaattgaaattgaaaacttatctttacgttacgcgccaaatttgcctcctgtcataagaaatgttagtttcaaagtggatcctcaaagtaagattgggattgtcggaagaactggcgcaggcaaatctaccataataacggcattattcagattactagaaccaataaccggatgtatcaaaatagatgggcaggatataagtaaaattgatctcgttacattacgtcgttccattactatcatccctcaggaccctattctatttgcaggtacaatcaaaagtaatgttgatccatatgatgaatatgatgaaaaaaaaatattcaaagcactttcacaagtaaatctaatttcttcacatgaatttgaagaagtgcttaactcggaggaacgctttaacagcactcataataaatttttaaatcttcacacagaaatagctgagggcggcttaaatctgtcccaaggtgaaaggcaattgctttttattgcacgatcattgttacgcgagccaaagataatacttttggacgaggctacttcctctattgattacgattctgaccatttaattcagggtattataagaagtgagtttaataaaagcacaattcttactattgcacatcgtttgagatctgttatcgattacgacaggataattgtgatggatgccggtgaggtaaaagaatatgatcgccctagtgaactgttgaaagatgaacgcggtatattttatagtatgtgtcgtgacagtgggggcctagagcttttgaagcaaatagccaagcaatcaagtaagatgatgaaataa

SEQ ID NO: 106 - protein, 1592 aa, Saccharomyces cerevisiae
MGTDPLIIRNNGSFWEVDDFTRLGRTQLLSYYLPLAIIASIGIFALCRSGLSRYVRSAECDLVNEYLFGAQEERKEDNSIERLLRNSNTQANYVNVKKQGRILKLRHFDITTIDVKQIDAKNHGGLTFSRPSTSDHLRKSSEIVLMSLQIIGLSFLRVTKINIELTNRDVTTLLLFWLILLSLSILRVYKRSTNLWAICFTAHTTIWISTWIPIRSVYIGNIDDVPSQIFYIFEFVITSTLQPIKLTSPIKDNSSIIYVRDDHTSPSREHISSILSCITWSWITNFIWEAQKNTIKLKDIWGLSMEDYSIFILKGFTRRNKHINNLTLALFESFKTYLLIGMLWVLVNSIVNLLPTILMKRFLEIVDNPNRSSSCMNLAWLYIIGMFICRLTLAICNSQGQFVSDKICLRIRAILIGEIYAKGLRRRLFTSPKTSSDSDSISANLGTIINLISIDSFKVSELANYLYVTVQAVIMIIVVVGLLFNFLGVSAFAGISIILVMFPLNFLLANLLGKFQKQTLKCTDQRISKLNECLQNIRIVKYFAWERNIINEIKSIRQKELRSLLKKSLVWSVTSFLWFVTPTLVTGVTFAICTFVQHEDLNAPLAFTTLSLFTLLKTPLDQLSNMLSFINQSKVSLKRISDFLRMDDTEKYNQLTISPDKNKIEFKNATLTWNENDSDMNAFKLCGLNIKFQIGKLNLILGSTGSGKSALLLGLLGELNLISGSIIVPSLEPKHDLIPDCEGLTNSFAYCSQSAWLLNDTVKNNIIFDNFYNEDRYNKVIDACGLKRDLEILPAGDLTEIGEKGITLSGGQKQRISLARAVYSSAKHVLLDDCLSAVDSHTAVWIYENCITGPLMKNRTCILVTHNVSLTLRNAHFAIVLENGKVKNQGTITELQSKGLFKEKYVQLSSRDSINEKNANRLKAPRKNDSQKIEPVTENINFDANFVNDGQLIEEEEKSNGAISPDVYKWYLKFFGGFKALTALFALYITAQILFISQSWWIRHWVNDTNVRINAPGFAMDTLPLKGMTDSSKNKHNAFYYLTVYFLIGIIQAMLGGFKTMMTFLSGMRASRKIFNNLLDLVLHAQIRFFDVTPVGRIMNRFSKDIEGVDQELIPYLEVTIFCLIQCASIIFLITVITPRFLTVAVIVFVLYFFVGKWYLTASRELKRLDSITKSPIFQHFSETLVGVCTIRAFGDERRFILENMNKIDQNNRAFFYLSVTVKWFSFRVDMIGAFIVLASGSFILLNIANIDSGLAGISLTYAILFTDGALWLVRLYSTFEMNMNSVERLKEYSSIEQENYLGHDEGRILLLNEPSWPKDGEIEIENLSLRYAPNLPPVIRNVSFKVDPQSKIGIVGRTGAGKSTIITALFRLLEPITGCIKIDGQDISKIDLVTLRRSITIIPQDPILFAGTIKSNVDPYDEYDEKKIFKALSQVNLISSHEFEEVLNSEERFNSTHNKFLNLHTEIAEGGLNLSQGERQLLFIARSLLREPKIILLDEATSSIDYDSDHLIQGIIRSEFNKSTILTIAHRLRSVIDYDRIIVMDAGEVKEYDRPSELLKDERGIFYSMCRDSGGLELLKQIAKQSSKMMK

SEQ ID NO: 107 - DNA, 1917 bp, Saccharomyces cerevisiae
atgaatcaacctcaaattggcacttacaatgtaggtacacagttaacagttgggtcacatcaggttgagatcattaaatatctaacaagcggtgggttcgctcaagtatattccgcgttaatcaacccacctgacccacattctaattcaagcgttgcatgcttaaaaagagtcattgttccagacaaacctagtctaaacactttaagagctgaagtagatgctatgaggttgctgaaaaacaataggtatgttgtatcttacattgattctcatgcagctaaggcaatgttacataatggttcgtatgaagtattcgtcttaatggaatattgtgaaagaggtggtctcattgattttatgaacacaaggctacaaaacaggcttcatgaatttgaaattttgcaaataatgagccaagttactcaaggagttgccgctatgcatgctttgcaacctccgttaattcaccgtgatataaagatagaaaatgttcttatctcagccaataatgagtacaagctttgtgactttggttctgtatgcggtattataaggcctcctaggaattcacaagagctatcatatgttcagcaagacattttgaaaaacacaactgcacagtaccggtcgccagagatgattgatacatttcgcggtctgccgatagatgaaaagtcggatatatgggcgctgggtatttttctatataagctttgctattacacaacaccgtttgaaaagggcggtgatcttgccatattaagcggaaagtttgaatttccattgtatccgaactacagtgaacagttgaaaggcttaatacgtgatatattggttcaagatccgcgccataggcctaacgtttatcaactactgaagaggatatcaattatgcaaaatgttccgtgtccaataaatgacatacaagtggttcaggcgcccagtagccatttgaatttgaccgaacttcatcagctttcggcaacacaaaatattctaagcttgaactctcccacaaccatggaaaatacgatgccgaacgctacatttcaaatcagcatggctgataatactacaacagcacaaatgcatcctaatagaaaaccatcacaaatagcatatgacgctagcttcagtaattccgccaaaggttctcaaccactttttgacaaatcacagaatatgtaccacgcattggatcctccacttgttgaaccgctagcgagtagtgtttcaaataatgacaacgaactcaaggcaaattccgcaaccaagttaaagcaggcaattgtctctgaagcacatacttttaggcagaataattcaatagactttccactacaaaacataataccccagtacgaagattcttcttcctcttcagatgaatcttattctggagacgtagatgaattaaagaaaactcgatctctaggttcttattccacacgcggtaacataaaaaaaaaccaatccgtaaaggaatctcttacttcatcaagcctaccaggcactagcttcaccccaacgtctacaaaggtaaatttgaaacacgaaaattcaccttttaagtcgacattcgttaatacgattgataattccaaagacgatcttaacaaaccatcttatgaagatttggacgtatctaagcagaatttgaagaactccattcaacagcgtatgatcgataaactcaactcttctgaggagtcattcaacgctaggaaaatgtccaaggtcaagctgcatgagaaaggggagatagataagccaacaatgctgaaatcaagtggcccgatttcaaaagacaaaaaaacaaaacctaccccaccacctaagccttcacatttaaagcctaaacctcctccaaaaccactgctcctcgcgggacgaaagttatccttggataagtga

SEQ ID NO: 108 - protein, 638 aa, Saccharomyces cerevisiae
MNQPQIGTYNVGTQLTVGSHQVEIIKYLTSGGFAQVYSALINPPDPHSNSSVACLKRVIVPDKPSLNTLRAEVDAMRLLKNNRYVVSYIDSHAAKAMLHNGSYEVFVLMEYCERGGLIDFMNTRLQNRLHEFEILQIMSQVTQGVAAMHALQPPLIHRDIKIENVLISANNEYKLCDFGSVCGIIRPPRNSQELSYVQQDILKNTTAQYRSPEMIDTFRGLPIDEKSDIWALGIFLYKLCYYTTPFEKGGDLAILSGKFEFPLYPNYSEQLKGLIRDILVQDPRHRPNVYQLLKRISIMQNVPCPINDIQVVQAPSSHLNLTELHQLSATQNILSLNSPTTMENTMPNATFQISMADNTTTAQMHPNRKPSQIAYDASFSNSAKGSQPLFDKSQNMYHALDPPLVEPLASSVSNNDNELKANSATKLKQAIVSEAHTFRQNNSIDFPLQNIIPQYEDSSSSSDESYSGDVDELKKTRSLGSYSTRGNIKKNQSVKESLTSSSLPGTSFTPTSTKVNLKHENSPFKSTFVNTIDNSKDDLNKPSYEDLDVSKQNLKNSIQQRMIDKLNSSEESFNARKMSKVKLHEKGEIDKPTMLKSSGPISKDKKTKPTPPPKPSHLKPKPPPKPLLLAGRKLSLDK

SEQ ID NO: 109 - DNA, 1686 bp, Saccharomyces cerevisiae
atgaacagagtaggggcagtgttcctatttgtatatgaaagaaatttttttttgtctattgttccagatcgtcacaggacggaaataagaatgtctagttcagaaaggtcagaagtcaagtttgacaagcactttaattggtggtccctattaggtatcgcgttctcattaagttgctcatgggtcggtatctcagcgtcgatggccgttggtattgccagtggagggccactgcttatcatctatgggttgataattgctgcttttttcagtctcatgtgtggtatatctctgggagattttgctgctatcctgccaaacagcagcggtggttcattttgggttcttaaaatgttggaacaagaatcagtcactttgaaaacccctgagtacgaggacccttctgacgatgatgaagaagtgttcctcgagaattattgtcaaactttcaacgtggaagtttcttctaaatttcaaaaggtttcttccatggttgtagggttgctgaactatttcggtgccatttttactaccgcaagtatctgctcatctttgtcaatgagctgtatcggtattcataagttgttgcatccggactacgagttaaagcactggcatgtttttgtgggttacgagtgtatcaatgccgttttgacacttttcaacatttattcaactccgttgccctatatctctcagtttgggctctatacgtctctattgtctttcgccatgactttcattatttgtattgtttcaagatctgacaacaccgtagacccatggcccaaagcttctaatatatttgggagctttgataatcaaacaggctggaattcgtctggaatggcgtttgttgtcggtttggtcaatccgatctgggcatttgttggcattgactctgctacgcacatgattgatgaagtgggttatagtaagtcacgtttcttagttcccaaagttattatcactaccatcattgtgggctttgtaactagttttatttattgcgttggtttgtttttctgcatcactgaccaaacggcagtcgttgagtctattttacctatcgtagaaatattttaccaggccactggtaataggaatctcagtgtcttcctgcaatgtatgtgtatcacaacaggttttgtttcaggcattgcaagtggaacctggcaaagtcgaatcctccaatcattcgggaaaagttacgcaccattttataaagagggttccttgggaaacaaatccttgaagaagctagcagtgttgacacctgggtttaagtctccattatatgcccattttttgtcacaaatatgtgtaacgataattggctgtatatttatgggatctagtaccgctttcaacgcaattatcactgcatgcatcaccctgttactaatgtcgtacgcagttccttcttttatattcctgttcgttattaaaaaggaaaaattcattcatagaatcgagagtgacgtaaattgtgtcagcaggcctaaccgtcgtcgtatgtctatgattcctcatattatatgtattctatggaccttgttctgcctggtatttttatctttcccatatacactaccggttactgcaggaaacatgaattacacctcagtagtgtatgcagtagttttctgcattatcagcatcgttgttttccctacatgcatctaa

SEQ ID NO: 110 - protein, 561 aa, Saccharomyces cerevisiae
MNRVGAVFLFVYERNFFLSIVPDRHRTEIRMSSSERSEVKFDKHFNWWSLLGIAFSLSCSWVGISASMAVGIASGGPLLIIYGLIIAAFFSLMCGISLGDFAAILPNSSGGSFWVLKMLEQESVTLKTPEYEDPSDDDEEVFLENYCQTFNVEVSSKFQKVSSMVVGLLNYFGAIFTTASICSSLSMSCIGIHKLLHPDYELKHWHVFVGYECINAVLTLFNIYSTPLPYISQFGLYTSLLSFAMTFIICIVSRSDNTVDPWPKASNIFGSFDNQTGWNSSGMAFVVGLVNPIWAFVGIDSATHMIDEVGYSKSRFLVPKVIITTIIVGFVTSFIYCVGLFFCITDQTAVVESILPIVEIFYQATGNRNLSVFLQCMCITTGFVSGIASGTWQSRILQSFGKSYAPFYKEGSLGNKSLKKLAVLTPGFKSPLYAHFLSQICVTIIGCIFMGSSTAFNAIITACITLLLMSYAVPSFIFLFVIKKEKFIHRIESDVNCVSRPNRRRMSMIPHIICILWTLFCLVFLSFPYTLPVTAGNMNYTSVVYAVVFCIISIVVFPTCI

SEQ ID NO: 111 - DNA, 621 bp, Saccharomyces cerevisiae
atgagtttcctaaacatttttacttttttcagcgtccttgtgtctgttgcaacagccgtcagatttgatttgactaacgtcacttgtaataacctacatggacctcactgtggtacctacgttatggaagtcgttggccaaaatggtacatttttgggtcaatctacgtttgctggtgccgacgttttaactgaaagcgctggtgacgcttgggcaagatatttgggccaggaaacaagattcctcccaaagttgactactattgctagcaatgatacgaagaacttttctccactaatcttcaccaccaatatctacacttgtaaccctcaatccattggtgatgctatggttccttttgctaacactgttactggtgaaattgaatacaactcttgggcagacaccgctgataatgcttccttcataaccggtttagctaaccaattgtttaactctactcagtatggcgttcaagttgcttcctgttacccaaactttgcttctgttattttgagcaccccaactgtgaacattttcgctgcgaatgagacattaccagattattgtaccgccatccagttgaaggccgtttgtccaccagacgctggttttgcttga

SEQ ID NO: 112 - protein, 206 aa, Saccharomyces cerevisiae
MSFLNIFTFFSVLVSVATAVRFDLTNVTCNNLHGPHCGTYVMEVVGQNGTFLGQSTFAGADVLTESAGDAWARYLGQETRFLPKLTTIASNDTKNFSPLIFTTNIYTCNPQSIGDAMVPFANTVTGEIEYNSWADTADNASFITGLANQLFNSTQYGVQVASCYPNFASVILSTPTVNIFAANETLPDYCTAIQLKAVCPPDAGFA

SEQ ID NO: 113 - DNA, 372 bp, Saccharomyces cerevisiae
atgaatattaattattattattgttataaatctatatgctcgtggatttttttaaataaattagacttacctgttatttacaagacttcttcgtttgacattagtccggcctgtgattctatgtcttgctcacctgcaatagcccgcgtagaaaaaagccttgaccaaaaattcccaatcgaaaatttggacttgaaatctgaaatcccatgtgattcaatatccggtggagtccacttcttcaacatcaatgaacttagaacgacactgaccgagctgaatgccatcgctaaaccggcgagcattggaggaagagttatgccccaaggaatgagcacacccatagcaatcggaatcatgaatatattatag

SEQ ID NO: 114 - protein, 123 aa, Saccharomyces cerevisiae
MNINYYYCYKSICSWIFLNKLDLPVIYKTSSFDISPACDSMSCSPAIARVEKSLDQKFPIENLDLKSEIPCDSISGGVHFFNINELRTTLTELNAIAKPASIGGRVMPQGMSTPIAIGIMNIL

SEQ ID NO: 115 - DNA, 1305 bp, Saccharomyces cerevisiae
atgaagactcagtactctctaatacgaaaaatttgggcacattcagtaacagaatttctgaaatcccagtggtttttcatctgtttggctattttaatcgttattgcaagatttgctccgaattttgcaagagacggagggttaattaaaggccaatatagtattgggtacggctgcgtcgcctggatttttctccaaagtggcctgggaatgaaatcaaggtcactaatggcaaatatgttaaattggagagctcatgccactattctggttctgagtttccttattacctcgtccatagtatatggattttgttgcgcggtaaaggctgctaatgatccgaaaatagatgactgggtacttatcggtctaattttgactgccacttgtccaacaaccgtggcttcaaacgttatcatgactacgaatgcaggtggaaatagccttttgtgcgtttgtgaagtattcattggaaatttgttgggtgcgtttattacacctgcattggttcaaatgtttactaaccgcgcaccatttgcatacggcaaccctgccactggaaatggcattggtgcgctttatggccgtgttatgaaacaggttggtctctctgtattcgtacccttgtttgtgggtcaggttattcaaaattgctttccgaagggtactgcttattacctgggctttttgaaaaaataccatattaaaattggatcttacatgcttttattgattatgtttagttcattctcaactgccttttatcaggatgcgtttactagcgtttctcatgtttgcatcatatttctctgcttttttaatttgggaatttatatattcttcacgggtctgtcatacttatgtgcaaggccatggttcatcctcaagcttttccctcatgaaccaatagagggcaaatctacaagattgtaccgctattcgtataatatctttaggcctttttattattcaaaggaagatgcgatttgcattatgttttgtggcccggctaaaactgcagcactgggtgtatcactaattacttcacaatacggcgataaaaaagaacacctgggtaagttgttggttcccttggttttatatcaagttgagcaagtcatgacggcaaatttctttgtaagcttgttcaaaagatggatacaaaaggacgctcaagcagacggaagcgagtcatcttgtgcaaatgagaatgaggaagttgatttggaaaagatcatatcaattggaactggtgaaaatcaatccgttctgtcgaacaacgtcccatatacacaaccaaggtga

SEQ ID NO: 116 - protein, 434 aa, Saccharomyces cerevisiae
MKTQYSLIRKIWAHSVTEFLKSQWFFICLAILIVIARFAPNFARDGGLIKGQYSIGYGCVAWIFLQSGLGMKSRSLMANMLNWRAHATILVLSFLITSSIVYGFCCAVKAANDPKIDDWVLIGLILTATCPTTVASNVIMTTNAGGNSLLCVCEVFIGNLLGAFITPALVQMFTNRAPFAYGNPATGNGIGALYGRVMKQVGLSVFVPLFVGQVIQNCFPKGTAYYLGFLKKYHIKIGSYMLLLIMFSSFSTAFYQDAFTSVSHVCIIFLCFFNLGIYIFFTGLSYLCARPWFILKLFPHEPIEGKSTRLYRYSYNIFRPFYYSKEDAICIMFCGPAKTAALGVSLITSQYGDKKEHLGKLLVPLVLYQVEQVMTANFFVSLFKRWIQKDAQADGSESSCANENEEVDLEKIISIGTGENQSVLSNNVPYTQPR

SEQ ID NO: 117 - DNA, 2136 bp, Saccharomyces cerevisiae
atgcattggacgtccatcttgagcgctattttgcttttctgcctgtcaggagcaagagcatcacctgcaaagacagttattcgtaacaaggtgcccttgcttgtcactaatgcctgcacgaggatttttcaaaaagttacttgggagtataccagcaagtctaagcgttcatcaccagtatgttcttacgaaccagcgtttcaatcaatgctgtattgtatctatgaaacgttggatgaaaaaggttattcgaataaaaccttagaaaaaacatttagtaccatcaaaaaaaactgtgcaagttatagtgatgctcttcagaacatgactaattctgagttttatgacgttctaaacaacggaacgaggcatatgacgccctatgtcaaaggcagtgcaaacctaacatatccagttgaaatggatacacagttaagaaaagcctactatcatgcattgcatggtttctatgctaacttagatgtcggaaacatatatggtggcattatatgtgcttattttgtcgctatcatggcttttgcaggcgttcttcattgcatgaattacactccctttaaaactgttctattgaagcaaaagcttgtgggatatgtaaggggatacctcactctacctaccattggaagcaaacatgcgtcagatttctcttattttagaatattcacaggatatttacctacaagattagagggtatcattattcttggatatctcgtgcttcataccgtttttttggcatacggttatgaatacgatcctgaaaatataatattcaagtctcgtagagttcaagttgctcgatatgtggcagacagaagtggtgtactcgcattcgcacactttccattaatagttcttttcgcgggaagaaacaactttctcgagtatatttctggggttaaatatacttccttcattatgtttcacaaatggttgggaagaatgatgtttttggatgctatgattcatggctctgcatatactagttatacggtagcgaataaaacttgggcaacaagtaaaaaccgattatattggcaattcggggtggcagcactttgtttagctggcacaatggttttcttttcctttgcagtattcaggaagtatttttatgaagcctttctttttcttcatatcgtccttggtgcaatgttcttttatgcatgttgggagcatgttgttagtttaagtggcattgagtggatatacactgctattgcgatttggatcgttgaccggattattagaattatcaaagcttcttattttggtttccccaaagcttccctacaactaatcggggatgatctcattcgtttaacagttaaaaaaccggcaaggccatggagggccaaacctgggcaatatgttttcgtttcgtttttacatccactgtacttctggcagtcacatccatttactgttttggattcagtaagcaagaatggtgaactggttattatcctgaaagaaaaaaagggagtaacaagacttgtcaaaaagtatgtgtgtcgcaatggaggtaagacatctatgagactagctatagaaggtccatatggttcttcatctccggtcaataattacaataatgtattgttactcactggaggtaccggtttgcctggacctattgcacatgcaattaaacttggaaagacgtcagcggctgctggaaaacaatctgtaaaattagtgattgcagttagaggattcgacgtactcgaggcttataagccggagttgatgtgtttagaaaatctgaatgtacagcttcacatctacaacacaatggaagtcccatcattaacccctagtgatagtttagatatttctcaacaggatgagaaggctgatgaaaaaggcactgttgtggcaactactttagaaaagtctgccaatccacttggttttgatggtgttgttttccattgcgggcgaccaaatgttaaggaacttctacatgaagcggctgaattgagtggctcattatctgtggtttgctgtggacctcctatttttgttgacaaagtgaggaatgaaaccgcaaaaatagttttagataagtctgcaaaagccattgagtactttgaagagtatcaatgctggtga

SEQ ID NO: 118 - protein, 711 aa, Saccharomyces cerevisiae
MHWTSILSAILLFCLSGARASPAKTVIRNKVPLLVTNACTRIFQKVTWEYTSKSKRSSPVCSYEPAFQSMLYCIYETLDEKGYSNKTLEKTFSTIKKNCASYSDALQNMTNSEFYDVLNNGTRHMTPYVKGSANLTYPVEMDTQLRKAYYHALHGFYANLDVGNIYGGIICAYFVAIMAFAGVLHCMNYTPFKTVLLKQKLVGYVRGYLTLPTIGSKHASDFSYFRIFTGYLPTRLEGIIILGYLVLHTVFLAYGYEYDPENIIFKSRRVQVARYVADRSGVLAFAHFPLIVLFAGRNNFLEYISGVKYTSFIMFHKWLGRMMFLDAMIHGSAYTSYTVANKTWATSKNRLYWQFGVAALCLAGTMVFFSFAVFRKYFYEAFLFLHIVLGAMFFYACWEHVVSLSGIEWIYTAIAIWIVDRIIRIIKASYFGFPKASLQLIGDDLIRLTVKKPARPWRAKPGQYVFVSFLHPLYFWQSHPFTVLDSVSKNGELVIILKEKKGVTRLVKKYVCRNGGKTSMRLAIEGPYGSSSPVNNYNNVLLLTGGTGLPGPIAHAIKLGKTSAAAGKQSVKLVIAVRGFDVLEAYKPELMCLENLNVQLHIYNTMEVPSLTPSDSLDISQQDEKADEKGTVVATTLEKSANPLGFDGVVFHCGRPNVKELLHEAAELSGSLSVVCCGPPIFVDKVRNETAKIVLDKSAKAIEYFEEYQCW

SEQ ID NO: 119 - DNA, 1884 bp, Saccharomyces cerevisiae
atggagtctgttcactctcgcgatcctgttaaggaggaaaagaaacatgtcttcatgggaatggaacacgagttgaatcctgagactcataacgattccaactccgactcatatggtctccctcagttatctgaaaaatacaatgccttgagacagaacaggagcctaattatccagcagactgaaatcattggctctgcttacaataaatggtacttacaagcgattttacttttgagtgctttcatatgtggctacggttatggactggacggtaacatccgttatatttacactggttacgccacatcatcctatagtgagcattctctgctgtctacaatcaacgtcattaatgctgtggtcagtgccgcttcgcaaatcatatacgctaggttgtctgatgtgtttggtagactataccttttcattagtgctgtcatcctatatgttgtgggtacaattattcaatcacaagcttatgatgttcaaagatacgctgcaggtgccattttctacaatgctggctatgtgggtgtaatccttattcttttgattatcctatccgatttttcatctttaaagtggagactgctgtatcaatttgtcccgacttggccttttatcatcaacacatggattgctggtaatatcacttccagagccaatcctgttgtcaactggtcttgggatgtaggtatgtgggctttcatctttcccctatcatgtgttccaatcgttttgtgtatgttgcacatgcaatggagggccagaaagactcctgaatggcacgctttgaagggccagaagtcctattatcaagaacatggttttattaagatcttaaagcaattattttggatgttagatgtcgttggtgtccttttgatgggttgttccctaggttgtatcttggtcccactgaccttggctggtggggtcaaaactacctggaatgattcaagattgatcggcccctttgttcttggctttgttttgatccctatcttatggatttgggaatatcgattcgctagagatccaattcttccatataggctggtcaaagatagggctgtatggtcttctatgggtatttctttcctgattgattttatttactatatggccgctgattatttgtacacggttatgattgttgccgtcaatgaatccgttaaatctgcaaccagaattgccacattatcttcatttgtctctactgtggcctctccatttttcgctttacttgtaacaagatgtacgagattgaaaccattcataatgtttggatgcgcgctatggatggtggctatgggtttattgtaccactttagaggtggaagtcagtcccattcaggtattattggtgcattatgtgtctggggtgtgggcactactttgttcacttacccagttaccgtctctgtacaatctgccgtctctcatgaaaacatggcgacagttacagctttaaactataccctctatagaattggttctgctgtcggttccgcagtttccggtgccatttggactcagactttgtacaaacaaattttgaagagaatgggtgatgttgctctagccacaactgcctacgaatctccatatactttcattgaaacctatacttggggtaccccacaaaggaatgccttaatgaacgcttacaaatacgttcaaagattggaaactatcgtggctttagtattttgtgttccattaattgcattctccttatgtctaagggatcctaaattgactgatactgttgctgtggaatacatcgaggatggcgaatatgtcgacacgaaagacaatgatccaattttggattggtttgaaaaacttccatcaaaattcacttttaaacgggaataa

SEQ ID NO: 120 - protein, 627 aa, Saccharomyces cerevisiae
MESVHSRDPVKEEKKHVFMGMEHELNPETHNDSNSDSYGLPQLSEKYNALRQNRSLIIQQTEIIGSAYNKWYLQAILLLSAFICGYGYGLDGNIRYIYTGYATSSYSEHSLLSTINVINAVVSAASQIIYARLSDVFGRLYLFISAVILYVVGTIIQSQAYDVQRYAAGAIFYNAGYVGVILILLIILSDFSSLKWRLLYQFVPTWPFIINTWIAGNITSRANPVVNWSWDVGMWAFIFPLSCVPIVLCMLHMQWRARKTPEWHALKGQKSYYQEHGFIKILKQLFWMLDVVGVLLMGCSLGCILVPLTLAGGVKTTWNDSRLIGPFVLGFVLIPILWIWEYRFARDPILPYRLVKDRAVWSSMGISFLIDFIYYMAADYLYTVMIVAVNESVKSATRIATLSSFVSTVASPFFALLVTRCTRLKPFIMFGCALWMVAMGLLYHFRGGSQSHSGIIGALCVWGVGTTLFTYPVTVSVQSAVSHENMATVTALNYTLYRIGSAVGSAVSGAIWTQTLYKQILKRMGDVALATTAYESPYTFIETYTWGTPQRNALMNAYKYVQRLETIVALVFCVPLIAFSLCLRDPKLTDTVAVEYIEDGEYVDTKDNDPILDWFEKLPSKFTFKRE

SEQ ID NO: 121 - DNA, 222 bp, Saccharomyces cerevisiae
atggcagagataaaacattatcaattcaatgtcgtcatgacctgctcgggatgttctggtgcagtcaataaagttttgacgaaattagaaccagacgtttccaaaatagatatatcccttgaaaagcaattagtagatgtatatactacacttccttacgattttattttagaaaagattaagaaaaccggaaaggaagttagatctggcaaacaattgtga

SEQ ID NO: 122 - protein, 73 aa, Saccharomyces cerevisiae
MAEIKHYQFNVVMTCSGCSGAVNKVLTKLEPDVSKIDISLEKQLVDVYTTLPYDFILEKIKKTGKEVRSGKQL

SEQ ID NO: 123 - DNA, 1821 bp, Saccharomyces cerevisiae
atgctggaaactgatcactctaggaatgacaatttagacgataaaagcactgtctgctacagcgaaaagacagatagcaatgttgagaagtctaccacgtctggcttgcgccgtatagacgctgtcaacaaggtcttgtctgactacagctctttcacagcttttggagttacgtttagttcactcaagaccgccctactggtggctctgtttttgcagggttactgtactggactcggagggcagatttcgcaatcaatacaaacctatgccgctaacagttttggaaagcattctcaagtaggatcgatcaataccgtcaaatcaatagtagcctctgttgtcgcagtgccatacgcacgtatatctgatcggtttggacgtatagaatgctggatttttgcgcttgtgctctatactattggagaaattatttctgctgctactccaacgttttccggactttttgcaggtattgttatacaacagttcggttattctggatttcgtcttcttgctacagcactgactggtgatctgtctggattgagagatcgtacatttgcgatgaacatatttctgattcccgtgattataaacacatgggtaagtggaaatattgttagctcagttgctggtaatgttgcaccatataaatggcgttggggctatggaattttttgcatcattgtgcccatctccaccctaatattggtccttccctatgtgtatgctcagtacatttcctggcgcagcggtaagttaccaccattaaaattgaaagaaaaaggacagaccctgcgtcaaacgctctggaaatttgcggatgacataaacttaattggagtcattcttttcactgctttcttagttttagtattattacctctcacaatagctggtggagccacctccaaatggagagagggtcacattattgcaatgattgtggttggtggctgcttaggttttatctttctaatttgggaattaaaatttgctaagaatccatttatcccacgagtatatctaggtgatccaaccatctacgttgcattgctaatggaatttgtatggcgtctaggtttgcagattgagttagagtatttggtcaccgtgttaatggtagcattcggagaatcaacattaagtgcgcagcggatagctcagctttacaattttctacagtcatgcactaatattgttgtcggcattatgctgcatttctatcctcatccgaaagtctttgtagtcgctgggtcgcttcttggtgtcatcggaatgggtcttttgtacaaatacagggtggtatatgacgggatttcgggtcttattggcgctgagattgtggtcggtatagctggtggtatgatacgttttcctatgtggacgctagtgcacgcttcaaccacccacaatgagatggcaactgtcactgggttactaatgtccgtttatcaaatcggagacgcagtaggtgcttccatcgctggtgctatatggactcagcgtctggcaaaggagttgatacagcgactcggctctagtttagggatggcaatctacaaatcaccactcaattatctaaaaaaataccctattggatcagaggttcgtgttcagatgatagaatcctattcgaagattcaacgcttattgataattgtgtccatttcgtttgcggctttcaatgctgttctctgttttttcttgcgtggctttactgtaaacaagaagcaaagtctttccgcagaagaacgagagaaagagaagctcaaaatcaaacaacaatcatggctccgtcgtgtaattggatattga

SEQ ID NO: 124 - protein, 606 aa, Saccharomyces cerevisiae
MLETDHSRNDNLDDKSTVCYSEKTDSNVEKSTTSGLRRIDAVNKVLSDYSSFTAFGVTFSSLKTALLVALFLQGYCTGLGGQISQSIQTYAANSFGKHSQVGSINTVKSIVASVVAVPYARISDRFGRIECWIFALVLYTIGEIISAATPTFSGLFAGIVIQQFGYSGFRLLATALTGDLSGLRDRTFAMNIFLIPVIINTWVSGNIVSSVAGNVAPYKWRWGYGIFCIIVPISTLILVLPYVYAQYISWRSGKLPPLKLKEKGQTLRQTLWKFADDINLIGVILFTAFLVLVLLPLTIAGGATSKWREGHIIAMIVVGGCLGFIFLIWELKFAKNPFIPRVYLGDPTIYVALLMEFVWRLGLQIELEYLVTVLMVAFGESTLSAQRIAQLYNFLQSCTNIVVGIMLHFYPHPKVFVVAGSLLGVIGMGLLYKYRVVYDGISGLIGAEIVVGIAGGMIRFPMWTLVHASTTHNEMATVTGLLMSVYQIGDAVGASIAGAIWTQRLAKELIQRLGSSLGMAIYKSPLNYLKKYPIGSEVRVQMIESYSKIQRLLIIVSISFAAFNAVLCFFLRGFTVNKKQSLSAEEREKEKLKIKQQSWLRRVIGY

SEQ ID NO: 125 - DNA, 1887 bp, Saccharomyces cerevisiae
atggaccctggtattgctaatcataccctccccgaggaatttgaagaggttgtcgttcccgagatgctggaaaaggaagtaggagccaaggtcgatgtcaagccaacgctaaccacatcttctccagcaccttcttacattgaattgatagatccaggtgtgcataacatcgagatttacgcagaaatgtacaaccgcccgatctaccgtgtcgcattattcttctcacttttcctcattgcctatgcttacggattagatggtaatatccgttacactttccaggcgtacgcgacttcgtcgtactcccagcactcgctgctatcgaccgtcaactgtattaagacggttattgcggctgtaggccagatcttctttgccagattatcagatatcttcggcagattttccattatgattgtcagtatcattttttatagcatggggaccatcattgagtcgcaagcggtgaatattacaagatttgcagttggtggttgtttttaccaattgggtcttaccggtattattctaattttggaagttattgcttctgacttttccaacttgaactggaggttgttagccttattcattccagctttaccatttatcatcaacacctggattagcgggaacgtaacaagtgccatagatgctaattggaaatggggtattggtatgtgggcttttatactgccgctagcttgtattccgcttggaatttgtatgttgcacatgaggtatttagcaagaaagcatgctaaagatagattgaagcccgagttcgaagcgctaaacaaattgaagtggaagtccttttgtatagacatcgcattttggaaattggatatcattggaatgttattaattactgtatttttcgggtgtgtattggttccattcaccttagcgggtggtttgaaagaggaatggaaaactgcgcatattattgtccctgaagtcattggttgggttgtagtgttaccactgtacatgctatgggaaataaagtactcgagacatccattgacaccttgggacttgattcaagatagaggtatctttttcgctctactcatcgcattctttatcaattttaactggtatatgcaaggtgattacatgtatactgtactagtcgttgcagttcatgaatccataaagtccgctacaagaattacctccttgtattcatttgtttctgttatcgttggtacaatcctcgggttcatactgattaaagttagaaggactaagccttttattatatttggcatttcttgttggatcgtctcatttggtttgctggtccattaccgtggtgactccggtgctcattccggtatcattggctctttgtgtctattaggtttcggtgcaggttcatttacctatgtgactcaagcttccatccaagcatccgctaaaactcatgcaagaatggcggtagtaacctcattataccttgccacttataatattggttctgcatttggtagttctgttagcggagctgtctggactaatatcctacccaaagaaatttcaaaaagaatttccgatccaaccttagctgcacaagcgtacggttctccatttacattcattacaacttatacctggggaacaccagaaagaatagctttagtcatgtcttaccgctatgttcaaaagattttatgtatcataggtttggtattctgctttcctttgttaggttgcgcattcatgttgagaaatcataaactaacagattctattgctcttgaaggcaatgatcatttggaaagtaaaaacacctttgaaattgaggaaaaggaagaaagttttttgaaaaataaattctttacgcactttacaagcagtaaagataggaaagattaa

SEQ ID NO: 126 - protein, 628 aa, Saccharomyces cerevisiae
MDPGIANHTLPEEFEEVVVPEMLEKEVGAKVDVKPTLTTSSPAPSYIELIDPGVHNIEIYAEMYNRPIYRVALFFSLFLIAYAYGLDGNIRYTFQAYATSSYSQHSLLSTVNCIKTVIAAVGQIFFARLSDIFGRFSIMIVSIIFYSMGTIIESQAVNITRFAVGGCFYQLGLTGIILILEVIASDFSNLNWRLLALFIPALPFIINTWISGNVTSAIDANWKWGIGMWAFILPLACIPLGICMLHMRYLARKHAKDRLKPEFEALNKLKWKSFCIDIAFWKLDIIGMLLITVFFGCVLVPFTLAGGLKEEWKTAHIIVPEVIGWVVVLPLYMLWEIKYSRHPLTPWDLIQDRGIFFALLIAFFINFNWYMQGDYMYTVLVVAVHESIKSATRITSLYSFVSVIVGTILGFILIKVRRTKPFIIFGISCWIVSFGLLVHYRGDSGAHSGIIGSLCLLGFGAGSFTYVTQASIQASAKTHARMAVVTSLYLATYNIGSAFGSSVSGAVWTNILPKEISKRISDPTLAAQAYGSPFTFITTYTWGTPERIALVMSYRYVQKILCIIGLVFCFPLLGCAFMLRNHKLTDSIALEGNDHLESKNTFEIEEKEESFLKNKFFTHFTSSKDRKD

SEQ ID NO: 127 - DNA, 1914 bp, Saccharomyces cerevisiae
atgatcgaagtcccagaagacaatcgttctagccaaacaaagcgtaagaatactgaaaaaaattgtaatgaactgatggttgatgaaaagatggatgacgattcgtcgcccagagatgaaatgaaagataaattaaagggaacaaaatcattgattattcgtaagtctgagctaatggctaaaaagtatgatacttggcaattaaaagctatattcctgttttctgcattcatttgcactttcgcttatggattagatagcagcataaggggtacatatatgacctacgcaatgaactcgtactccgcacattctctcatttctacagtaagcgtcatagttctaatgatatctgctgtttcacaggtgatctttggagggttatcagatatctttggaaggctaacgttgtttcttgtatccattgtactttacattgtgggtacaataattcaatctcaagcatatgatgtccagaggtatgctgctggagctgtcttttattatgtgggacttgtcggtgttatgctacaggttgttttgatgttgtctgataattcttcattaaaatggaggctattttacacattgataccttcatggccctcgattatcactacgtgggtctcaggtagtgtagtggaggcagcaaacccgttagagaactggtcgtggaatattgctatgtgggcgttcattttccctctatgctgtatcccattgattttgtgtatgctccatatgagatggaaagtaagaaatgacgtggaatggaaagaattacaggatgaaaaatcgtactatcaaacgcacggattagtacaaatgctggtacagttgttctggaagctagatgttgtcggtgtgttgttgtttactgctggtgttggttgtattcttgtaccactcactcttgctggtggcgtctctacaaattggagaaattcaaagattatcgggccctttgtgcttggctttgtcctggttccaggcttcatatattgggaaagtcgacttgctttggttcctttcgctccattcaagctgctaaaagatcgtggcgtgtgggccccattgggaattatgttttttatctgctttgtatatcaaatggctgctgggtatctctacaccattctagtagttgcggtagatgagagcgcttcctcagctacaagaataataaacttatactcttttgtgactgctgttgttgctccatttctggggctcatcgttacgagatcatctagattgaagtcgtatattatttttggtggctcactttatttcattactatgggactattttaccgctacaggtcaggtcaagacgccgatggaggtataattgctggtatggttatttggggtctcagtagttgtttattcgattatcctacaattgtttctattcagtcggtaacatcccatgagaatatggctactgtcacagcattaaactatacagttttcagaataggtggagcagttgcagctgccatttccggtgccatatggacgcagtcattgtaccctaaattattgcactacatgggagacgctgacctggctacagcagcatatggctcaccactaacttttattctttccaatccctggggtactccagttaggtctgcgatggttgaagcttacagacacgttcaaaaatacgaagttattgttgcgcttgtattttcagcgcctatgttccttctaacattctgcgtaagagatcctcggttgactgaagattttgcccaaaagttacctgacagagaatatgtccaaaccaaggaagatgatcctatcaatgactggatcgcgaaacgttttgcaaaggccttaggaggtcataagaaagatttacaaaaccccaacaggatatgtgttcgaaaaaatgatctctga

SEQ ID NO: 128 - protein, 637 aa, Saccharomyces cerevisiae
MIEVPEDNRSSQTKRKNTEKNCNELMVDEKMDDDSSPRDEMKDKLKGTKSLIIRKSELMAKKYDTWQLKAIFLFSAFICTFAYGLDSSIRGTYMTYAMNSYSAHSLISTVSVIVLMISAVSQVIFGGLSDIFGRLTLFLVSIVLYIVGTIIQSQAYDVQRYAAGAVFYYVGLVGVMLQVVLMLSDNSSLKWRLFYTLIPSWPSIITTWVSGSVVEAANPLENWSWNIAMWAFIFPLCCIPLILCMLHMRWKVRNDVEWKELQDEKSYYQTHGLVQMLVQLFWKLDVVGVLLFTAGVGCILVPLTLAGGVSTNWRNSKIIGPFVLGFVLVPGFIYWESRLALVPFAPFKLLKDRGVWAPLGIMFFICFVYQMAAGYLYTILVVAVDESASSATRIINLYSFVTAVVAPFLGLIVTRSSRLKSYIIFGGSLYFITMGLFYRYRSGQDADGGIIAGMVIWGLSSCLFDYPTIVSIQSVTSHENMATVTALNYTVFRIGGAVAAAISGAIWTQSLYPKLLHYMGDADLATAAYGSPLTFILSNPWGTPVRSAMVEAYRHVQKYEVIVALVFSAPMFLLTFCVRDPRLTEDFAQKLPDREYVQTKEDDPINDWIAKRFAKALGGHKKDLQNPNRICVRKNDL

SEQ ID NO: 129 - DNA, 3201 bp, Saccharomyces cerevisiae
atggtaaagcagcagggatccggcaagaccaacttggccaacgaagatgaagcatatgaagctatttttggcggagagtttggctctttagaaatcgggtcatacattggcggggatgaaggtgccaattcaaaggactatacggagcatttgccggatgctgtagattttgaagatgaagatgaacttgctgatgacgatgacgatttgccagaagaatctgatgctaatttgcatccagctatgatgactatgggcgcgtatgatgatgtaaacgagaacggtgccgtactcggtatcgactcaaatagtttgaatatgcaactgcctgaaattaatggtgatttgtctcaacagtttattttggaggatgatgggggtactcccgcaactagcaatgctttgtttatgggaatggatgcaaatgaaattcatctcgccactgaaactggagttcttgatggtagtggcgcaaatgaaattgggcattctcaactttccattggtggcgttaatggaaatgatatgtcgataaatggcggatttatcatggaaccagatatgtcagatggcaagcataagaaagccaccaaattagacttgataaaccatgagaagtatcttctaaaaaaatactttcctgattttgaaaagggtaaaattttaaaatggaacaagctgatttatagaagatctgttccttatcattggcacagtgaaatatctagggtaaagaaaccgtttatgcctttaaatttgaaattcaaggttcaacaggatgataagaggttatttaactcaaggacaatatcttacgtcgctccgatttatcaagggaaaaacaatttacttcaaagtaactcttctgcatcccgaagaggtttaattcatgtttccattgatgaacttttccctattaaagagcaacaaaaaaaaagaaagattattcatgatgaaaagaccatatcggaagacttgcttattgccactgatgattgggaccaagaaaaaatcatcaatcaaggtacttcatcaacagcaaccttggcggattcgtctatgacacccaacttaaagttctccggcggttataaattgaagagcttgattgaggatgttgctgaagattggcagtgggatgaagacatgatcattgatgcaaaattgaaagagtctaaacatgctgaattaaatatgaatgacgaaaaactgttgctgatgattgagaaaacgaataatttagcgcagcaaaagcaacaactggatagtagtaacttgatattgcccctcaacgaaactattttgcaacaaaaattcaatttatctaatgatgataaatatcaaatcttgaaaaaaacccatcaaacaaaagttcgttctaccatctcgaacttaaatattcagcattctcaacctgcgattaatttacaatctccattttacaaagtggctgttcctagataccagttgaggcatttccaccgtgaaaactttggttcgcacatcagaccaggtactaaaattgtcttcagtaagttaaaagcgcgtaaaaggaaaagagataaaggtaaagatgtcaaagaatcattttctacatctcaagatctaaccatcggggatactgctcctgtttatttaatggaatattctgaacaaacaccggtagctttgtctaaatttggtatggccaataaattaattaattattatcggaaagccaatgaacaagatactctaaggcccaaattgcctgttggcgaaactcacgttttgggagttcaagacaaatcaccattttggaactttggatttgttgaacctggtcatatcgtccccacattatacaataacatgattagagcacccgttttcaaacatgatatatcaggaacagattttcttctgacaaaaagttccggatttggtataagcaatcgattttacttacgtaatattaaccatctttttacggttggacaaacttttcctgtcgaggagattcccggacctaattcaagaaaggtgacatcaatgaaagctacaagactgaaaatgattatttatagaattctaaaccataatcacagcaaggcaatttctattgatcccattgcaaagcactttcccgaccaagattatggacaaaacagacaaaaagtgaaggagttcatgaaatatcaaagagatggtcctgaaaaaggtctgtggaggcttaaagatgatgaaaaattgttagacaatgaagcagtgaaaagtttaattacgccagagcagatcagccaagttgaatcaatgagtcagggcttacaattccaagaagataatgaagcatataattttgattctaagctaaaatctctagaagaaaacttgttaccatggaacattacaaaaaattttattaattcaacacaaatgcgagctatgatacaaatacatggtgttggtgacccaacgggctgtggtgaaggtttttctttcttgaaaacttcaatgaaaggtggttttgttaagtctggttctccttccagtaataacaatagttcaaacaaaaaaggcactaacacgcatagctacaatgtggctcaacagcaaaaagcttacgacgaagaaattgcgaagacctggtatacacatacaaaatcgttgagcataagcaatccttttgaggaaatgaccaatcctgatgagattaatcagaccaacaagcatgttaagacggatagagatgataagaaaattctgaagattgttagaaagaaaagagatgaaaatggtataattcaaaggcagacaattttcataagagatcctagggtcattcaaggatatataaaaatcaaagaacaggataaagaagatgttaacaaattgttagaggaggacacttcaaagataaataacttggaagaacttgagaaacagaaaaaactgttgcaactagaattagctaatttggaaaaatcacagcaacgtagagcagcaaggcaaaattcgaagagaaatggtggtgccacgagaacagaaaactctgtggataatggtagcgaccttgccggtgtaactgacgggaaagcagccaggaataaaggtaagaacactacaaggagatgtgctacatgcggacaaatcgggcacattagaacaaataaatcttgtccaatgtatagcagtaaagataaccctgcttcaccaaagtag

SEQ ID NO: 130 - protein, 1066 aa, Saccharomyces cerevisiae
MVKQQGSGKTNLANEDEAYEAIFGGEFGSLEIGSYIGGDEGANSKDYTEHLPDAVDFEDEDELADDDDDLPEESDANLHPAMMTMGAYDDVNENGAVLGIDSNSLNMQLPEINGDLSQQFILEDDGGTPATSNALFMGMDANEIHLATETGVLDGSGANEIGHSQLSIGGVNGNDMSINGGFIMEPDMSDGKHKKATKLDLINHEKYLLKKYFPDFEKGKILKWNKLIYRRSVPYHWHSEISRVKKPFMPLNLKFKVQQDDKRLFNSRTISYVAPIYQGKNNLLQSNSSASRRGLIHVSIDELFPIKEQQKKRKIIHDEKTISEDLLIATDDWDQEKIINQGTSSTATLADSSMTPNLKFSGGYKLKSLIEDVAEDWQWDEDMIIDAKLKESKHAELNMNDEKLLLMIEKTNNLAQQKQQLDSSNLILPLNETILQQKFNLSNDDKYQILKKTHQTKVRSTISNLNIQHSQPAINLQSPFYKVAVPRYQLRHFHRENFGSHIRPGTKIVFSKLKARKRKRDKGKDVKESFSTSQDLTIGDTAPVYLMEYSEQTPVALSKFGMANKLINYYRKANEQDTLRPKLPVGETHVLGVQDKSPFWNFGFVEPGHIVPTLYNNMIRAPVFKHDISGTDFLLTKSSGFGISNRFYLRNINHLFTVGQTFPVEEIPGPNSRKVTSMKATRLKMIIYRILNHNHSKAISIDPIAKHFPDQDYGQNRQKVKEFMKYQRDGPEKGLWRLKDDEKLLDNEAVKSLITPEQISQVESMSQGLQFQEDNEAYNFDSKLKSLEENLLPWNITKNFINSTQMRAMIQIHGVGDPTGCGEGFSFLKTSMKGGFVKSGSPSSNNNSSNKKGTNTHSYNVAQQQKAYDEEIAKTWYTHTKSLSISNPFEEMTNPDEINQTNKHVKTDRDDKKILKIVRKKRDENGIIQRQTIFIRDPRVIQGYIKIKEQDKEDVNKLLEEDTSKINNLEELEKQKKLLQLELANLEKSQQRRAARQNSKRNGGATRTENSVDNGSDLAGVTDGKAARNKGKNTTRRCATCGQIGHIRTNKSCPMYSSKDNPASPK

SEQ ID NO: 131 - DNA, 2085 bp, Saccharomyces cerevisiae
atgcttttcgctagattagtgctgctgttggtgtatttggcaccaggttctttagcaaaaccagcatcaactaagaaaagaacgcaatgggaccagatagcaattgatgcttgtgctaaagaattggaatcacacaaatttgacacggatgtgaagggtcggcacgctactctttgcacttatgaaccagcactagggtcttggttacattgcgcgaaggatgttctcgacagtaggaagaaaagtaaaaaaatattcgaaaaaacgtttagcaaaattaatcagtattgccacgattatcacaaagatgaggtcgtcagcaatgaggagtattatcgaatttttgccaatgcatcccttttcatccggcctcttgatgaggtaaaggaaaacatacgatatcccgtcactcccaataaagcctctctagataggtgggtatgggcttattttgggcccctggataatatagacaaaggaaatgtttatggagtgacgatttgcttatactggataggagttctgtttattgcagctgtatatcacttcttgaacttttctcgacttaaacaaacggtgttcaaaaacaaggtgtctgctttcttaagaggccactatgttcttccagcgcttgttcataaccatgctatgtcagtgggaaggtggtttttcatcggtctggtccctaccaggttagagacccttgtcctattcggttacgttttgttgcacgggttcttgttgagtagttacaattttgaccataatgagttgctcagtgatcgcagaagccaagtgcttatcttcctttccgacagggcagggatcctggcattcgcacattttcctttgatagttctctttggcggtaaaaacagcacaatgacttggctcacaggtataagatataccgcattcattacttaccacaaatggttaggaagattcatgttagtagactgtacgatccatgcaataggatacacctaccatgcatacatagaaaattactggaaatacgtgaagtatagtgatctatggacatccggaagacatgccatgatcattgttggaatacttgtgtttttttcgttcttcttctttagacgacattattacgaattgtttgttattacgcacattatcttagcaataggatttttccatgcgtgctggaaacattgctataaacttggatggggtgaatggataatggcgtgtgcactgttttggattgctgaccgtattctgcggctaataaagattgcaatttttggaatgccatgggctaaattgaaactgtgtggcgagtccatgatagaagtgagaatctcaaaaagctccaaatggtggaaagcagaacctggccaatatatatatctgtacttcttaagaccaaaaatattctggcaatcacatccattcacggtcatggattctttggttgaggatggtgagttggtagttgtgataacagtgaaaaatgggctaaccaaaaaattacaggaataccttttagagagcgaagggtacacggaaatgcgagtactagcagaaggaccttatggacaaagcacgcgaacacatttgttcgaaagcctcctgtttattgccggaggggcgggtgttcctggacctctgtcgatggcaataaaggcaggtcgccaggtcaaaagcaacgattctcatcaaatgatcaaatttgtgtggagtgtacgtaaccttgatctcttagaagtgtatcgcaaagagataatggtgctaaaagagttgaacatagacacaaaaatttacttcacaggagagcgaaaagatgaatcgaacacggaggagggagcaattgctaatatgagcacggaaggcagactgctgacgacatcgaaatcagcggaaatgattactgattttggacgaccaaatatcgatgagataattgaagaagcagtaagtggtgcaaaatctttgttggtcacttgttgcgggtcagagggctttgtagacaagacacgagagttgacggcaaaaagagttcttgaacacggtgacaaatggatagaatacgtggaggaattccagaattggtag

SEQ ID NO: 132 - protein, 694 aa, Saccharomyces cerevisiae
MLFARLVLLLVYLAPGSLAKPASTKKRTQWDQIAIDACAKELESHKFDTDVKGRHATLCTYEPALGSWLHCAKDVLDSRKKSKKIFEKTFSKINQYCHDYHKDEVVSNEEYYRIFANASLFIRPLDEVKENIRYPVTPNKASLDRWVWAYFGPLDNIDKGNVYGVTICLYWIGVLFIAAVYHFLNFSRLKQTVFKNKVSAFLRGHYVLPALVHNHAMSVGRWFFIGLVPTRLETLVLFGYVLLHGFLLSSYNFDHNELLSDRRSQVLIFLSDRAGILAFAHFPLIVLFGGKNSTMTWLTGIRYTAFITYHKWLGRFMLVDCTIHAIGYTYHAYIENYWKYVKYSDLWTSGRHAMIIVGILVFFSFFFFRRHYYELFVITHIILAIGFFHACWKHCYKLGWGEWIMACALFWIADRILRLIKIAIFGMPWAKLKLCGESMIEVRISKSSKWWKAEPGQYIYLYFLRPKIFWQSHPFTVMDSLVEDGELVVVITVKNGLTKKLQEYLLESEGYTEMRVLAEGPYGQSTRTHLFESLLFIAGGAGVPGPLSMAIKAGRQVKSNDSHQMIKFVWSVRNLDLLEVYRKEIMVLKELNIDTKIYFTGERKDESNTEEGAIANMSTEGRLLTTSKSAEMITDFGRPNIDEIIEEAVSGAKSLLVTCCGSEGFVDKTRELTAKRVLEHGDKWIEYVEEFQNW

SEQ ID NO: 133 - DNA, 2139 bp, Saccharomyces cerevisiae
atgcatagaacgcttctgtttttaacgtggctgatatctttaacaaaggcttttaatataaaattaccacacactgaaaaaaaagaccatttggaatccaacgctgtgctggcatgcgcatcctatataaatactctgaagtggtcatttgatagctccgtcgtaccgggtttctattctaccatatgctcttattcaccagcgtttgatacttggtcactttgtatcttcaattcgcttacagaccagattattcccatggacaacacaagtttcgaagaaagcttgggtaacgtacgaaaaacgtgctcgtttgtcgataaaaagtttagcaatatttcactggagcaatactactcatctttaaataatgcttcttctcacgctttggaagactatggttctattgaaagtttatcgacatccattcgagtcgatcgtgagacaagatctagatggatacgagcttttcatgcgcatgcctataatttagatatcagcagtgtttatggtgcatatttaacttactacttcgtcatagtgggtattatcgccgtcttcttccatatgagtcactataacggcctgaatcgagcgctatttgcaagccggttcgtcaattatattcggggccattttgtgttgcctacgtttttagtagataagcacgctaatcacttcaagtttctaaacgtggaagtctttacgggactgatgccgaattccttggaggcatggatcatttttggatacacattggcgaacatcatatttttgtccataagttacatcatagacccatataacctcattttcaacagtcacctgtcgcagtttacaagactgttggctgatagatctgggatactggcgtttactcagttccctctcattatcatttttacggcaaggaatagttttctcgaatttttaacaggagtcaagttcaattcctttattagtttccataaatggatcggtagaatcatggtcttaaacgcaacgatacattcgctttcttattcattattcgcaattatcaaccatgccttcaaaataagcaacaaacagctctattggaagtttggtattgcatccataacagtgctttgcgttctactagttctatcgctcggaatagtaaggaaaagacattacgaatttttcctgtacacccacatcatactagcccttttgttcttttactgttgttggcaacacgtcaaaattttcaacggttggaaagaatggatagtggtatccttgctcatttgggggctggaaaagcttttcagaatatggaacattttgcagtttagatttccgaaagcaacactaatcaatttgaacaccagcaacaacccgcacgatgaaatgtttaaagtaatcatacccaaatataaccggagatggcattcgaaaccgggtcaatattgtttcatttattttttacatccattggtattttggcaatgccatccatttaccattatcgacgaaggtgagaagtgtgttttagtgatcaaacctaaaagtggtctcactagattcatttataaccatattttgcaatctttaaatggtaaattacaactccgagtggccattgagggaccttatgggcccagtaatcttcacctcgataaattcgaccatttgctgttactaagtggaggaacaggcttgcctggtccattagatcatgccattaagctgtcacgaaaccctgataaacccaagagtatagatttgatcatggcgatcaaaaatccttcttttcttaacggctataaatccgagatactagagctaaaaaatagccgatcccacgtcaacgtgcaggtttaccttacacagaaaacagctgttacaaaggcagcaaacgcacgagaccaattaatacattttgatgatataatgaccgaactgacaagcttcgcccacatcggcaatgcaagacctaattttagcaatgtaattgaaaacgcaataaaaagtacgccgcctggagattcattagcggtcgtgtgctgcggccctcctgttctggtggacgatgttagaaacaccgtttctcaaaaactcctcggttacccagagagaattatagagtatttcgaggaatatcagtgttggtaa

SEQ ID NO: 134 - protein, 712 aa, Saccharomyces cerevisiae
MHRTLLFLTWLISLTKAFNIKLPHTEKKDHLESNAVLACASYINTLKWSFDSSVVPGFYSTICSYSPAFDTWSLCIFNSLTDQIIPMDNTSFEESLGNVRKTCSFVDKKFSNISLEQYYSSLNNASSHALEDYGSIESLSTSIRVDRETRSRWIRAFHAHAYNLDISSVYGAYLTYYFVIVGIIAVFFHMSHYNGLNRALFASRFVNYIRGHFVLPTFLVDKHANHFKFLNVEVFTGLMPNSLEAWIIFGYTLANIIFLSISYIIDPYNLIFNSHLSQFTRLLADRSGILAFTQFPLIIIFTARNSFLEFLTGVKFNSFISFHKWIGRIMVLNATIHSLSYSLFAIINHAFKISNKQLYWKFGIASITVLCVLLVLSLGIVRKRHYEFFLYTHIILALLFFYCCWQHVKIFNGWKEWIVVSLLIWGLEKLFRIWNILQFRFPKATLINLNTSNNPHDEMFKVIIPKYNRRWHSKPGQYCFIYFLHPLVFWQCHPFTIIDEGEKCVLVIKPKSGLTRFIYNHILQSLNGKLQLRVAIEGPYGPSNLHLDKFDHLLLLSGGTGLPGPLDHAIKLSRNPDKPKSIDLIMAIKNPSFLNGYKSEILELKNSRSHVNVQVYLTQKTAVTKAANARDQLIHFDDIMTELTSFAHIGNARPNFSNVIENAIKSTPPGDSLAVVCCGPPVLVDDVRNTVSQKLLGYPERIIEYFEEYQCW

SEQ ID NO: 135 - DNA, 2136 bp, Saccharomyces cerevisiae
atgtattgggtcctcctttgtggttctattttgttatgctgcttgtcaggagcaagcgcctcccctgctaagacaaaaatgtacggcaagttaccactggttttgacagatgcctgcatgggagttctcggcgaagtaacctgggagtatagtagtgacgatttatattcctcaccagcatgtacatatgaaccggcattacagtcaatgttgtattgtatttacgaatcattgaatgaaaagggttattccaatagaacctttgaaaaaacctttgctgctatcaaagaagactgcgcatattacactgataaccttcagaatatgactaatgcagatttctataatatgctgaataatggaacaacatacataatacagtattctgaaggtagcgcgaatcttacgtatccaatcgagatggatgcccaagtgagagaaaactattattattcttaccatggtttctacgccaactacgacattggtcatacttatggtggtattatttgcgcctattttgtaggtgttatgattcttgccagcatactccattatctaagttacactccgtttaaaactgccttatttaaacaaagacttgtaagatatgtgagaagatatttgacaatacctactatctggggtaaacatgcgtcgagcttttcttaccttaaaatttttacaggcttccttcccacacgatctgaaggcgtcattatacttggatacctcgtgcttcatacagtttttctggcatacgggtatcaatatgatccttacaacttaattttcgactctcgtagagaacagattgctcgatacgtggcagatagaagtggtgtcctggcatttgcacattttcccctaatagctcttttcgcaggaaggaacaattttctagaattcatttctggagtaaaatatacctctttcataatgtttcataagtggttgggaagaatgatgtttttagatgctgtgattcatggcgctgcttataccagttattccgtattctacaaagattgggcagcaagcaaggaagagacatattggcaatttggagtagctgctctttgtatagttggtgttatggtgtttttttctttggcaatgttcagaaagtttttctatgaagccttcttatttctccatattgtgcttggcgcattgttcttttatacgtgttgggagcacgtcgtagaattgagtgggattgagtggatatacgctgctattgctatctggactattgataggctaattcgaattgttagagtatcttatttcggtttccctaaggcttccttacagttagttggcgatgacatcattcgagtcacagtcaaacgaccagtaaggctatggaaagccaaaccaggacagtatgttttcgtttcattcctacaccacctgtatttttggcagtcacatcctttcacagtcttagattcaattatcaaagatggtgagctgactattatcctgaaggaaaaaaagggagtaacaaaacttgtcaaaaagtatgtgtgttgcaatggaggtaaggcatctatgagactagctatagaaggtccatatggctcttcatctccagtcaataattatgataacgtcttgctacttacgggaggtactggtttgccagggcccattgcacacgccattaaacttggaaaaacgtcagcggcaactggaaaacaattcataaaattagtgattgcagttagagggtttaacgtactcgaggcttacaagccggagctgatgtgtctagaagatcttaatgtacagcttcacatctacaatacaatggaagttccggcattaactcctaatgatagtttggaaatttctcaacaagacgagaaggccgatggaaaaggtgttgttatggcaactaccctagaacagtcacctaatccagttgaatttgatggtactgtttttcatcatggaagacccaatgttgaaaagcttctgcatgaagttggtgacctaaatggatcgttagctgtggtttgttgtgggcctcctgttttcgttgacgaagtaagggatcaaacggcaaatcttgttctagagaagcctgcaaaggcaatcgaatactttgaagaataccaaagttggtaa

SEQ ID NO: 136 - protein, 711 aa, Saccharomyces cerevisiae
MYWVLLCGSILLCCLSGASASPAKTKMYGKLPLVLTDACMGVLGEVTWEYSSDDLYSSPACTYEPALQSMLYCIYESLNEKGYSNRTFEKTFAAIKEDCAYYTDNLQNMTNADFYNMLNNGTTYIIQYSEGSANLTYPIEMDAQVRENYYYSYHGFYANYDIGHTYGGIICAYFVGVMILASILHYLSYTPFKTALFKQRLVRYVRRYLTIPTIWGKHASSFSYLKIFTGFLPTRSEGVIILGYLVLHTVFLAYGYQYDPYNLIFDSRREQIARYVADRSGVLAFAHFPLIALFAGRNNFLEFISGVKYTSFIMFHKWLGRMMFLDAVIHGAAYTSYSVFYKDWAASKEETYWQFGVAALCIVGVMVFFSLAMFRKFFYEAFLFLHIVLGALFFYTCWEHVVELSGIEWIYAAIAIWTIDRLIRIVRVSYFGFPKASLQLVGDDIIRVTVKRPVRLWKAKPGQYVFVSFLHHLYFWQSHPFTVLDSIIKDGELTIILKEKKGVTKLVKKYVCCNGGKASMRLAIEGPYGSSSPVNNYDNVLLLTGGTGLPGPIAHAIKLGKTSAATGKQFIKLVIAVRGFNVLEAYKPELMCLEDLNVQLHIYNTMEVPALTPNDSLEISQQDEKADGKGVVMATTLEQSPNPVEFDGTVFHHGRPNVEKLLHEVGDLNGSLAVVCCGPPVFVDEVRDQTANLVLEKPAKAIEYFEEYQSW

SEQ ID NO: 137 - DNA, 1362 bp, Saccharomyces cerevisiae
atgaacaacacttccataaccggaccacaagtactacatagaacaaaaatgagaccactaccagtgctagaaaaatactgtatctcgccacatcatgggtttttggacgaccggttacccttgaccagactgagcagcaagaaatatatgaaatgggaagaaatcgttgctgacctgccctctcttttgcaagaggataacaaggtgcggagcgtcatcgatgggctggatgtcttggacttggatgagacgatcttgggcgacgtcagggagctcagaagagcatattccattttggggtttatggcgcacgcttatatttgggccagcggaactccccgggatgtattaccggagtgtattgcaaggccactgttggagacagcacatattttgggtgtgccaccgttagctacgtactcctcgttggtgttatggaacttcaaagtgaccgacgagtgcaagaaaacggaaaccgggtgtttggacttggaaaatattacaacgataaacacatttacgggaaccgttgacgaaagttggttttatctggtcagcgtgcggtttgaaaaaatcggcagcgcttgtttaaaccatgggttgcagatattgagagccattagaagcggtgataaaggagacgctaacgtgatagacgggttggagggcttggctgcaacgatcgaaaggttatcgaaagccttgatggaaatggagcttaagtgtgaacccaatgtattttatttcaagataagaccatttttggccgggtggacgaatatgtcgcatatggggttaccacagggtgttaggtatggagcggaaggacagtatcggatcttttctggcgggtccaatgcgcaaagctcgttgatacagacactggacatccttttgggtgtgaaacacactgcgaatgctgcgcattcttcccaaggagacagcaagatcaattatctggacgaaatgaaaaaatacatgccaagagaacatcgtgaatttctttaccatttggaatcggtatgtaatattcgcgaatacgtttctcgtaacgcttctaaccgtgcattgcaagaggcctatggacgttgcatttccatgctgaaaatatttagagataaccacattcaaattgttaccaagtacattattttgccctccaattcaaagcaacacggctccaataagccgaacgtactaagtccaatcgagcccaataccaaagcaagtggttgtttagggcataaagttgcctcatctaagactatcggaaccggtggtacaagattaatgcccttcttaaagcagtgcagggacgagactgtcgccactgcggacattaaaaatgaagataaaaattga

SEQ ID NO: 138 - protein, 453 aa, Saccharomyces cerevisiae
MNNTSITGPQVLHRTKMRPLPVLEKYCISPHHGFLDDRLPLTRLSSKKYMKWEEIVADLPSLLQEDNKVRSVIDGLDVLDLDETILGDVRELRRAYSILGFMAHAYIWASGTPRDVLPECIARPLLETAHILGVPPLATYSSLVLWNFKVTDECKKTETGCLDLENITTINTFTGTVDESWFYLVSVRFEKIGSACLNHGLQILRAIRSGDKGDANVIDGLEGLAATIERLSKALMEMELKCEPNVFYFKIRPFLAGWTNMSHMGLPQGVRYGAEGQYRIFSGGSNAQSSLIQTLDILLGVKHTANAAHSSQGDSKINYLDEMKKYMPREHREFLYHLESVCNIREYVSRNASNRALQEAYGRCISMLKIFRDNHIQIVTKYIILPSNSKQHGSNKPNVLSPIEPNTKASGCLGHKVASSKTIGTGGTRLMPFLKQCRDETVATADIKNEDKN

SEQ ID NO: 139 - DNA, 1113 bp, Saccharomyces cerevisiae
atgtcgaaacagtgggcgagtggtacaaacggagctttcaaaagacaggtttcgtccttcagagaaacaatctctaagcaacacccaatttataagccagcaaagggaagatattggttgtatgtttcacttgcatgcccatgggcccatagaacactaattacgagggctttgaagggattaacctctgttataggatgtagcgtagtccattggcaccttgacgagaaaggatggagatttttggacatggaaaagcaattggaggacagtgaagattttttggaacattggcacgatgttgcaggtggtattagaactgctaaagaggattccagcaagagcttcgccgagatcaagaatgacagtcaaagattcatggttgatgctaccaatgagcctcactatggatacaagagaatcagtgacttatattacaagagcgatcctcaatactcggcaaggttcaccgtcccagtcctgtgggacttagaaacccaaacaattgttaacaacgaaagtagcgaaattataaggattttgaactctagtgcgttcgatgaatttgtcgacgacgatcacaagaaaacggaccttgttcctgctcagttgaaaacacagatcgatgacttcaattcttgggtttacgacagcatcaacaatggtgtatacaagaccggattcgcagagaaagcagaagtttacgaaagtgaagtcaacaacgtatttgaacatttggacaaagtggagaaaatcctgagtgacaaatattccaaattgaaggccaaatacggtgaagaagatagacaaaaaatcttgggtgagttcttcactgtgggtgatcaattaacagaagctgacattagattgtatactaccgtcataagattcgatcctgtgtacgtccaacatttcaaatgcaattttacctctattagagccggatatccatttattcatttgtgggtaagaaatttatactggaattatgatgccttcaggtacacaacagattttgaccatatcaagttacactacacgcgttcccacacaaggatcaaccccttgggaattacgcccctgggacccaagccagatattcgtcctttataa

SEQ ID NO: 140 - protein, 370 aa, Saccharomyces cerevisiae
MSKQWASGTNGAFKRQVSSFRETISKQHPIYKPAKGRYWLYVSLACPWAHRTLITRALKGLTSVIGCSVVHWHLDEKGWRFLDMEKQLEDSEDFLEHWHDVAGGIRTAKEDSSKSFAEIKNDSQRFMVDATNEPHYGYKRISDLYYKSDPQYSARFTVPVLWDLETQTIVNNESSEIIRILNSSAFDEFVDDDHKKTDLVPAQLKTQIDDFNSWVYDSINNGVYKTGFAEKAEVYESEVNNVFEHLDKVEKILSDKYSKLKAKYGEEDRQKILGEFFTVGDQLTEADIRLYTTVIRFDPVYVQHFKCNFTSIRAGYPFIHLWVRNLYWNYDAFRYTTDFDHIKLHYTRSHTRINPLGITPLGPKPDIRPL

SEQ ID NO: 141 - DNA, 645 bp, Saccharomyces cerevisiae
atgtcatttaacagtccattttttgatttctttgacaacatcaacaacgaagttgatgcctttaacagattgctgggtgaaggcggcttaagaggctacgcaccaagacgtcagttagcaaacacacccgcaaaggattctactggcaaggaagttgctagaccaaataactatgctggcgctctttatgatcccagagatgaaaccttagatgattggttcgacaatgacttgtccctgttcccatctggtttcggtttccctagaagtgtcgcagttccagttgatattttggaccatgacaacaactacgagttgaaagtcgtggttcctggtgtcaaaagcaagaaggacattgatattgagtaccatcaaaacaagaaccaaattttggtttctggtgaaattccatctaccttgaatgaagagagtaaagacaaggtcaaggtcaaggagagcagctctggtaagttcaagagagtcatcactttgccagactacccaggtgtggatgcagacaacattaaagcagactacgcaaatggtgttttgacattaacagttccaaaattgaagcctcagaaggatggtaagaaccacgtcaagaagattgaggtttcttctcaagaatcgtggggtaactaa

SEQ ID NO: 142 - protein, 214 aa, Saccharomyces cerevisiae
MSFNSPFFDFFDNINNEVDAFNRLLGEGGLRGYAPRRQLANTPAKDSTGKEVARPNNYAGALYDPRDETLDDWFDNDLSLFPSGFGFPRSVAVPVDILDHDNNYELKVVVPGVKSKKDIDIEYHQNKNQILVSGEIPSTLNEESKDKVKVKESSSGKFKRVITLPDYPGVDADNIKADYANGVLTLTVPKLKPQKDGKNHVKKIEVSSQESWGN

SEQ ID NO: 143 - DNA, 1230 bp, Saccharomyces cerevisiae
atgggcaatatccttcggaaaggtcagcaaatatatttagcaggtgacatgaagaagcaaatgttgctaaataaagatggaacacctaagaggaaggtgggcagaccaggcagaaaaaggattgactctgaagctaagagtaggaggactgcccagaatagggcagctcaacgagcgttccgagataggaaagaagccaaaatgaagagtttgcaagagagggtagagttactagaacagaaagatgcgcagaataagactaccacggactttttactatgttctttaaaaagtttactgtcggaaattacaaaatatagagctaagaattctgatgatgaaagaatattagccttcctcgatgatctgcaagaacaacagaaaagggaaaacgaaaaaggaacaagtacagcagttagcaaggctgcaaaggaattgccatcgcctaattcagatgaaaacatgactgtgaacacaagtatagaagtacagccgcacactcaagagaatgagaaagttatgtggaacataggctcatggaacgctcccagtttaaccaattcgtgggattctccccccggaaatcgaacaggtgccgttaccatcggtgacgaaagtattaatggtagtgaaatgccagatttcagtctcgatcttgtctccaatgatagacagactggtctagaagctttagattacgacattcataactactttcctcagcactctgaacgcctgaccgctgaaaaaatagatacgtcagcatgtcaatgtgaaattgaccaaaagtatcttccatacgagacagaagatgatactttattccccagcgtgcttccccttgctgtagggagccagtgtaataatatttgcaaccgcaagtgtatcgggaccaaaccatgttcaaataaggagatcaaatgcgacttaataacaagccacctgttgaatcagaaatctctagcttcggtgcttccggtggctgcttctcatactaaaacaattcgaacccaatctgaagcaattgaacacattagcagcgccatatcgaatggaaaagcgtcttgctaccacattctcgaagagatctcctccctaccaaaatattcatcgttggacatagatgatttatgcagcgaattaataatcaaggcaaaatgtacagatgactgcaaaatagtagtcaaagctcgcgacttacagagtgctctggttagacagctcctgtag

SEQ ID NO: 144 - protein, 409 aa, Saccharomyces cerevisiae
MGNILRKGQQIYLAGDMKKQMLLNKDGTPKRKVGRPGRKRIDSEAKSRRTAQNRAAQRAFRDRKEAKMKSLQERVELLEQKDAQNKTTTDFLLCSLKSLLSEITKYRAKNSDDERILAFLDDLQEQQKRENEKGTSTAVSKAAKELPSPNSDENMTVNTSIEVQPHTQENEKVMWNIGSWNAPSLTNSWDSPPGNRTGAVTIGDESINGSEMPDFSLDLVSNDRQTGLEALDYDIHNYFPQHSERLTAEKIDTSACQCEIDQKYLPYETEDDTLFPSVLPLAVGSQCNNICNRKCIGTKPCSNKEIKCDLITSHLLNQKSLASVLPVAASHTKTIRTQSEAIEHISSAISNGKASCYHILEEISSLPKYSSLDIDDLCSELIIKAKCTDDCKIVVKARDLQSALVRQLL

SEQ ID NO: 145 - DNA, 1545 bp, Saccharomyces cerevisiae
atggaggaacaacgtgaaatactggaacaattgaagaaaactctgcagatgctaactgtagagccatctaaaaataaccaaatcgccaacgaagaaaaggaaaagaaagaaaatgaaaattcgtggtgcatcctcgagcacaattatgaggatattgcacaggaattcattgatttcatttacaagaaccctaccacttaccatgtagtatcatttttcgcggagctgttagataagcataacttcaaatacttgagcgagaaatccaattggcaggactccattggcgaagatggtgggaaattctacactataagaaatggaactaacctatctgcctttatcctgggcaaaaactggagagccgaaaagggtgtcggtgtcattggatctcatgtggacgctttgacggtcaaattgaagcccgtctcctttaaagacacagcggaaggttacggaagaattgctgttgctccctatggaggtacactgaatgaattgtggctagacagagacctaggtattggtggtcgccttctttacaagaagaagggcactaacgaaattaaaagcgccttggttgattctacacccctacctgtttgtcgaattccttccttggctccccatttcggtaaacctgctgaaggcccatttgataaagaggaccaaactatcccggtcatcggcttccccactccggatgaggaaggtaatgaacctcccacggatgatgaaaagaaatcgcccttatttggcaaacactgcatccacctgttaaggtacgttgccaaattagccggtgtggaagtgtccgaattgattcaaatggatttagacttattcgatgtgcaaaagggtaccattggaggtattggtaaacacttcctttttgcaccacgtctagatgacaggttgtgtagtttcgcagcaatgattgctttgatttgctacgctaaggatgttaataccgaggaatcagatttattctctactgtcactttgtatgataatgaagaaatcggatcgttgacaagacaaggcgcaaaaggtggcttgttggagtcagtggtggaacgcagttcttctgcattcactaagaaaccggtcgatttgcatacggtttgggctaattccatcatcttgtccgcagacgtcaaccacctctacaacccaaactttcctgaagtctatttgaagaatcattttccagtgcctaatgtcggaatcactttatcactggatcctaacggtcatatggccacagatgtcgtaggaactgccctagtagaagaattagcacgccgcaatggagacaaagtgcaatatttccaaatcaaaaacaactcaagatcaggtggtactatcggcccatcattggcttctcaaacaggtgctcgtaccatagacctgggaattgcacagttgtccatgcacagcatcagagctgctacagggtccaaggatgtcggattaggtgttaagttcttcaacggatttttcaagcactggagatcagtctacgatgaattcggcgagttgtga

SEQ ID NO: 146 - protein, 514 aa, Saccharomyces cerevisiae
MEEQREILEQLKKTLQMLTVEPSKNNQIANEEKEKKENENSWCILEHNYEDIAQEFIDFIYKNPTTYHVVSFFAELLDKHNFKYLSEKSNWQDSIGEDGGKFYTIRNGTNLSAFILGKNWRAEKGVGVIGSHVDALTVKLKPVSFKDTAEGYGRIAVAPYGGTLNELWLDRDLGIGGRLLYKKKGTNEIKSALVDSTPLPVCRIPSLAPHFGKPAEGPFDKEDQTIPVIGFPTPDEEGNEPPTDDEKKSPLFGKHCIHLLRYVAKLAGVEVSELIQMDLDLFDVQKGTIGGIGKHFLFAPRLDDRLCSFAAMIALICYAKDVNTEESDLFSTVTLYDNEEIGSLTRQGAKGGLLESVVERSSSAFTKKPVDLHTVWANSIILSADVNHLYNPNFPEVYLKNHFPVPNVGITLSLDPNGHMATDVVGTALVEELARRNGDKVQYFQIKNNSRSGGTIGPSLASQTGARTIDLGIAQLSMHSIRAATGSKDVGLGVKFFNGFFKHWRSVYDEFGEL

SEQ ID NO: 147 - DNA, 636 bp, Saccharomyces cerevisiae
atgagcaccgcattcaacgattactgcactgtttgtgatcgtctcattccaacatctccacagaaaacgaacattaataccaggaagatccaaagggacaatgaaaccaagagcagtttacaatcaaataagttatattgctccgaagattgtaagctgaaggattcgaaccctcttaatgagaaattattatcccacttgcataaaaaatcaaaaacttctcattcgcataatctcactccaccgctttcatattctaaaaatttaactgcatcaaacctcttcgagccgactacctcactatcttcatctccgacatcttcaactatcccctttgacgagttggagaagctagagtccttattaatttcaccattgctgctacctcaggatggtatagtcaatcctaagcaggagtctaatccttctcgtgttgacgaatatgatgaaaatgaacattatttgaacttagccgactctcttagactcgattctagttaccaattgcattcaaaggcacatttgggttacgaaaacaacttgccacgatcaaacgatctaattgatgatcatttgatctcagatcagatcattgagaataactacaacctatggtttagactatcctccagttaa

SEQ ID NO: 148 - protein, 211 aa, Saccharomyces cerevisiae
MSTAFNDYCTVCDRLIPTSPQKTNINTRKIQRDNETKSSLQSNKLYCSEDCKLKDSNPLNEKLLSHLHKKSKTSHSHNLTPPLSYSKNLTASNLFEPTTSLSSSPTSSTIPFDELEKLESLLISPLLLPQDGIVNPKQESNPSRVDEYDENEHYLNLADSLRLDSSYQLHSKAHLGYENNLPRSNDLIDDHLISDQIIENNYNLWFRLSSS

SEQ ID NO: 149 - DNA, 837 bp, Saccharomyces cerevisiae
atgagagcaccaccttcaccgagaaagtccaaatctggtcattttttttacctatattttcgactgtgtcaactgttcagtggccggaaattaaagaggaggtggcatgtccacaaacttcacattcaccaatataatactcgctggaacttgagccccctctccgaaatacacattgaggacatgataaatgaaccgtctggactatgtccaggaagttccaaaaagaaaccactactgattgcaaggtttcccaagggttgccaagaatcaccaagggtatatgtactgcaaaggaacaatttgtctcgtttaaaattaagcaaaagaaaatatgccctaaggttctatcacaatgaaatttttggcaataatttaaagagaaaagacggaagcatccacaaagttgaacaccaacagtgcgcagaaaccgttagaaagatcaagaaagtcacagcaaaccatgctgatgttaaaataatatttcacgataaaaatactataagaagtgacaaattagggggtaggagtaataagatgcagactaggcctagtgttcttgaagaggatgtagaagaagaagtctcttcggtatatatcagattttgtgacgaccattccctgagagttaaagattatcactctttgcacaggcattctaaaaaatcttctaaagaaaaacgaaataatcaggagattggaaaatctaagttgcttgggaagctttttgaagaggaaacatcgcgtcaaaacaaaggtgtagagaagaaactagatacgattgtgatacagaaatttcaaaattatcctattgtctccttctctcgtgtcatttaa

SEQ ID NO: 150 - protein, 278 aa, Saccharomyces cerevisiae
MRAPPSPRKSKSGHFFYLYFRLCQLFSGRKLKRRWHVHKLHIHQYNTRWNLSPLSEIHIEDMINEPSGLCPGSSKKKPLLIARFPKGCQESPRVYVLQRNNLSRLKLSKRKYALRFYHNEIFGNNLKRKDGSIHKVEHQQCAETVRKIKKVTANHADVKIIFHDKNTIRSDKLGGRSNKMQTRPSVLEEDVEEEVSSVYIRFCDDHSLRVKDYHSLHRHSKKSSKEKRNNQEIGKSKLLGKLFEEETSRQNKGVEKKLDTIVIQKFQNYPIVSFSRVI

SEQ ID NO: 151 - DNA, 3657 bp, Saccharomyces cerevisiae
atgataaaaaatggtacatgcccctattgggaacgtgatgatctttcggaatgtgctaggcgagaatatatcgagtttaaatttcctctatttatattgttgactggtatgatatacgcgttttgcaaagtctttcgagccttttatctaagggggaaaaatcatacaaatgaagcgccagaatttgaagaacaaggtaatggaaaccacgaatatgcaaggttctcagttttaagactaaaatctgcatgggaaagccgtagcttttgtaatgttaataatagatctactttcgacaaattcaaaaaatttatagagggtgccttcattgttttgcagcttactatccacctgtatattttatctagtatgccaatggataacaaaaagttctttcaccaaggttttctggttcaaatgtttctctggattttactgcttgttgttattacacttcgtttaatttcagcaagccagtcatttcggtgggttttagcatgtaagcgtgatttatgggctgtttcgttttactcatatgcatccctgtttactctttcgattttacctcttcgttccgtcttcattggaaagataaaagataaaattatggtcaaatatatcatttccgagactttcattgatttagcgcttttattattattatcaacgtcaagtatagaaggaactaggtactcatttttggttgaaaatgagaacaaaaagttgccaccggctcctaccgtctttggccttcttactttttctaggattgatcggcttatttggaaagcatacaaacactgccttggaaacgctgatatttgggatttggatattaataataagtctatagcaattttggcgaactttgaaatgtcttctaaaaaaggaaggctccttccaaacattatttgttattttaaggctgttttcatctcccaattatttctggcttttgtatctagttttttgaactttgtaccctcattgttgatgccaagaatactatcatacgttaatgacccaaagtcaaaatcatggaacttggtgtctttatacgtctcatctatgctcgtcagtaaaatcattgccacgacttgtagaggtcaaggattgtttttaggtgaaaagggtactatgcaactaagaacagttttgatatccaatatctattccaaaaccttaagaagaacaattctaaaagactcaacaacgtcacttcaaaaaaatgcgtcaacatcctttgaagaaaatcctgactcttctgaagcggaacctagaaaaaagtctagtaggaaagacaactctgtgaacaatgttatgtcaattgacgctttcaaggtttctgaagctatgaacactttttatctggcatgtgaagcagttttcatgacagttacggccctaatgatactatattccctactgggatggtccgcctttgctggtacctttgctcttcttgccatgattcctttgaatttttggtgtgcaactttttacgggaactatcaggccgatcaattaatcctaactgacaagcgtacctctgggattagtgaggctctgaactcaatacgtgtaataaagctactggcatgggaaaatctgttttatcaaaagattataaacgtaagagatggggaaataagactccttaaaaagaaggcaacaattttctttttgaaccatctcatttggttctttgggcccactttggtctctgcaataacattctcagtgtttattaaattccaaaatcagacacttactcctacaatagcatttacagctctttctttatttgcaatattgaggacacccatggaccaaattgcttcgactgtcagccttttgatacagtcttttatttctcttgaaagaatccaggattatcttaatgaatcagaaacaagaaaatatgagattttggaacaaagcaatactaaatttggctttgaagatgcaagcatggaatgggaagctgctgaaacaagttttaaacttaagaacatttctattgattttaagctgaatagtctcaacgcaattataggtccgactgggtcaggaaagtcttcgctattacttggactattgggagaattgaaccttctttctggaaaaatatacgtacctacagttgaatcccgcgacgacttagagattggtaaagacggaatgacgaattcaatggcatattgttctcaaactccgtggttgattagtggaacaattaaagataacgttgtttttggagaaatcttcaacaaacaaaaatttgatgatgtaatgaaatcctgttgtcttgacaaagatatcaaagcaatgacagctggcataagaacagacgtgggtgatggaggattttccttatctggcggacagcagcaaaggattgctttagccagagcaatttactcctcttccaggtatttgatccttgatgattgcttgagtgcagtagatcctgaaactgcactttatatatatgaagagtgtttatgcggccccatgatgaaaggaaggacctgcatcattacgagtcataatatttctttagttacgaaacgggctgactggcttgtgattttagatcgtggcgaggtgaaatcacagggtaaaccatcggacctcattaaatctaatgagtttttgagggaaagcataaacaatgattcaaaaaatacaactcacaatcaaattgacttgaaaagatcaacaacatcaaagaaaactaagaatggagatcccgagggagggaactcgcaagacgaagtgtgtgctgaagttgaaaattttgaggaaacaaaaatggaaggatcagttaaattttcagcttacaaatggttagcagactatttcgggggactgggagttgtttttgttttcacctcgtcctccatccttattcatggaatcacactgtctcagggcttttggctcagatactggctggacactggatcttcagggagtaagtctacctggctttatagaatagttgagggtcactctaacatctatttcttactgacttatattatcataggtcttgtttcttcatttttaacttctggtaaagtttggatagcaataatttcaggtaccaacgtcaccaagaaaatatttgcgaagcttctatccagtatcttatatgccaagttacgttttcataatgtcacgccgactggaagaataatgaacagatttagcaaggatatggatattattgatcaacaattgatccctaatttcgaaggactctcttatagcgtcgttgtttgtctgtggattatacttttaattggatatgttactcctcaatttctgttatttgctattcctttatgcgctctttattataccgtatgtacgttatatcttcgtgcatctagagagttgaagagaatagataacatcaatatctctccaatacaccagttattcgctgaagccatcaaaggagtaactacaattagagcattagcagatgagcgtaggtttatcactcaatctttggttgcaattgacagaagtaatgctccatttttttatctcaatatggccaccgagtggatcacatatagagtggatataattgggacacttgttctttttagttcttctgtaatgatcataatgaaggcctcatag

SEQ ID NO: 152 - protein, 1218 aa, Saccharomyces cerevisiae
MIKNGTCPYWERDDLSECARREYIEFKFPLFILLTGMIYAFCKVFRAFYLRGKNHTNEAPEFEEQGNGNHEYARFSVLRLKSAWESRSFCNVNNRSTFDKFKKFIEGAFIVLQLTIHLYILSSMPMDNKKFFHQGFLVQMFLWILLLVVITLRLISASQSFRWVLACKRDLWAVSFYSYASLFTLSILPLRSVFIGKIKDKIMVKYIISETFIDLALLLLLSTSSIEGTRYSFLVENENKKLPPAPTVFGLLTFSRIDRLIWKAYKHCLGNADIWDLDINNKSIAILANFEMSSKKGRLLPNIICYFKAVFISQLFLAFVSSFLNFVPSLLMPRILSYVNDPKSKSWNLVSLYVSSMLVSKIIATTCRGQGLFLGEKGTMQLRTVLISNIYSKTLRRTILKDSTTSLQKNASTSFEENPDSSEAEPRKKSSRKDNSVNNVMSIDAFKVSEAMNTFYLACEAVFMTVTALMILYSLLGWSAFAGTFALLAMIPLNFWCATFYGNYQADQLILTDKRTSGISEALNSIRVIKLLAWENLFYQKIINVRDGEIRLLKKKATIFFLNHLIWFFGPTLVSAITFSVFIKFQNQTLTPTIAFTALSLFAILRTPMDQIASTVSLLIQSFISLERIQDYLNESETRKYEILEQSNTKFGFEDASMEWEAAETSFKLKNISIDFKLNSLNAIIGPTGSGKSSLLLGLLGELNLLSGKIYVPTVESRDDLEIGKDGMTNSMAYCSQTPWLISGTIKDNVVFGEIFNKQKFDDVMKSCCLDKDIKAMTAGIRTDVGDGGFSLSGGQQQRIALARAIYSSSRYLILDDCLSAVDPETALYIYEECLCGPMMKGRTCIITSHNISLVTKRADWLVILDRGEVKSQGKPSDLIKSNEFLRESINNDSKNTTHNQIDLKRSTTSKKTKNGDPEGGNSQDEVCAEVENFEETKMEGSVKFSAYKWLADYFGGLGVVFVFTSSSILIHGITLSQGFWLRYWLDTGSSGSKSTWLYRIVEGHSNIYFLLTYIIIGLVSSFLTSGKVWIAIISGTNVTKKIFAKLLSSILYAKLRFHNVTPTGRIMNRFSKDMDIIDQQLIPNFEGLSYSVVVCLWIILLIGYVTPQFLLFAIPLCALYYTVCTLYLRASRELKRIDNINISPIHQLFAEAIKGVTTIRALADERRFITQSLVAIDRSNAPFFYLNMATEWITYRVDIIGTLVLFSSSVMIIMKAS

SEQ ID NO: 153 - DNA, 420 bp, Saccharomyces cerevisiae
atgaataagctcaaagtaagccagaacaattacctacaaagaagtgatttctataaattcgaaagaaacggcactgaatgggaatatatatttgcatcaaattcagcttgtcttgattataataataatacagctgttaataatgatataatttcgtcacttaattattgcatcagtgatgacagatattatgaaactgcagcgatgtgtgtggttttgaaattatctcaagattgctcttttgatgtgaggcttcaacgaagtggaaatgggccatataagaatatctgggatatgccttgcggagaattacaacaacacattggttacaaaaatggtatatgctataatagtgaaaacacggtgttatcggcagtaggtgtagaacatcgatatcataaaagtgtttctcgtctataa

SEQ ID NO: 154 - protein, 139 aa, Saccharomyces cerevisiae
MNKLKVSQNNYLQRSDFYKFERNGTEWEYIFASNSACLDYNNNTAVNNDIISSLNYCISDDRYYETAAMCVVLKLSQDCSFDVRLQRSGNGPYKNIWDMPCGELQQHIGYKNGICYNSENTVLSAVGVEHRYHKSVSRL

SEQ ID NO: 155 - DNA, 1239 bp, Saccharomyces cerevisiae
atgaaaattgcggtagaaacgacactattcgacttctttgtcatcgatcagtttaaaaaatctactttttcagcgccaaacaccaaagttgacactattaagggttgtattaacaagtttattgaacaatttaatgtatatgatgagcaacacatattttggcaacctcctggaaaatcaaacgtcagattgctgtcaaacgccaatgactttggccaattgggaaactttttgcataagaaaatcaaatgtaacatttttattggagaagaagcattaaggaaatacgatttaaatatctgtggaccttatgacaaatttgtagaaaattctgaccctagtgttaaaaaggttgtgaacagagatgatgtcatgttgtcgcgcaaatgtttaaacatcatatcggaacaactctctatacttgagaagtccataagtaaggctcaaaaccaagtgttgcagtcaagtgaggttgaaggaaaaaaatgtattatcttgccggaagataaaccagaactcatcaagtttttttctaaatttgaaacgagtgttcagttacaggaggtttacgagggctataaggtatatgaaaagctattacaaaaatttggtgggcaaaaaaaaagaatggagtctttcttgaatgaaaacacgccaatgtcaggtgccgaagctatcaagcaaataaatatatctgaggagctcaaggaaaaaggggaacgtttaacaacaccaaacgatccgttattacacgttgaggtgagtaatgaggataactcgctgcactttatattgtacaataaaacgaatatcataattccaggaaattgtacatttgaattttctagccaaatctccgaggtattcagtatcaaaatgggaccgcatgagataggcataaagggtcagaaagagctatggttttttccatcattacctactcctctctccaattacacaatgaaagtcgtaaaccaggatggagaaactattctggttggtaaatgtgctgactccaatgaaataactctaaaatctccactagcctcattttcgacaggcagtttccagacaggcagtttccacactttgcaagatcctactaatgttttccgggcagacgcgctttcttcccctgatgaatcaagcatcatgagcactccctttctaggcgagacagatgaagtttataattctggctctacattaagtaggccatttacttgggaagaaatataa

SEQ ID NO: 156 - protein, 412 aa, Saccharomyces cerevisiae
MKIAVETTLFDFFVIDQFKKSTFSAPNTKVDTIKGCINKFIEQFNVYDEQHIFWQPPGKSNVRLLSNANDFGQLGNFLHKKIKCNIFIGEEALRKYDLNICGPYDKFVENSDPSVKKVVNRDDVMLSRKCLNIISEQLSILEKSISKAQNQVLQSSEVEGKKCIILPEDKPELIKFFSKFETSVQLQEVYEGYKVYEKLLQKFGGQKKRMESFLNENTPMSGAEAIKQINISEELKEKGERLTTPNDPLLHVEVSNEDNSLHFILYNKTNIIIPGNCTFEFSSQISEVFSIKMGPHEIGIKGQKELWFFPSLPTPLSNYTMKVVNQDGETILVGKCADSNEITLKSPLASFSTGSFQTGSFHTLQDPTNVFRADALSSPDESSIMSTPFLGETDEVYNSGSTLSRPFTWEEI

SEQ ID NO: 157 - DNA, 1008 bp, Saccharomyces cerevisiae
atggttaatgaaaaagtgaatccattcgacttagcttcggtttctcctttagtcttaggaggtgcaatactgaaccagcaatatacagatgagccagaatccattccactggaagacataatcaaatacgcattttcgcatggtatcaatgcaattgacacttctccctactatggccctagtgaggttctttatggtagggcactgtccaatttaaggaatgaatttcccagagacacttattttatatgcacaaaggttgggcgtattggtgcggaagagtttaactattctagagatttcgtgagatttagtgttcacagatcgtgcgaaagattacacactacatatctcgatttggtgtacttgcacgatgtcgagtttgtcaaatttccagacatcttagaggcattaaaggaattgaggaccttgaagaacaaaggagttatcaaaaattttggcatatcaggctacccaatcgactttatcacctggcttgctgagtactgctctaccgaggaaagtgatattgggtcattggatgcagtattgtcctattgtaacttgaacttacaaaacaataagctattgaactttcgagaaagactgctacgcaatgctaaactgaaaatggtttgcaacgcatcaatcttgagcatgtcgctactaaggtcacaggagacaagacagtttcacccgtgttctcatgaattgagagaatgcgcatctcaggctgccaaatactgtcaagaacaaaatgtcgacttagccgatttggccacaagatacgcgatttcggaatgggtaggaaagggacccgttgttcttggagtcagtagcatggaagaattgaaacttgctctggataattacgaaattgtgaaatcgaatggcaacagattatcttctaaggacggacaactagtagaatatatccaaaagaatatttttaaagaacattttaatgaagagtggtcttcaggtattcctcatccagaaatgatataa

SEQ ID NO: 158 - protein, 335 aa, Saccharomyces cerevisiae
MVNEKVNPFDLASVSPLVLGGAILNQQYTDEPESIPLEDIIKYAFSHGINAIDTSPYYGPSEVLYGRALSNLRNEFPRDTYFICTKVGRIGAEEFNYSRDFVRFSVHRSCERLHTTYLDLVYLHDVEFVKFPDILEALKELRTLKNKGVIKNFGISGYPIDFITWLAEYCSTEESDIGSLDAVLSYCNLNLQNNKLLNFRERLLRNAKLKMVCNASILSMSLLRSQETRQFHPCSHELRECASQAAKYCQEQNVDLADLATRYAISEWVGKGPVVLGVSSMEELKLALDNYEIVKSNGNRLSSKDGQLVEYIQKNIFKEHFNEEWSSGIPHPEMI

SEQ ID NO: 159 - DNA, 1422 bp, Saccharomyces cerevisiae
atgcgatcttatatgcagattcttcaaaaatttgccaaatttattgggccagggatattagtcagtgtggcttatatggacccaggaaattatgccactagtgtttccggtggtgctcaatacaaatataccttattattctctatttttatatccaacatttttgccgtacttttgcaatgtctctgtgtgaagctgggtactatcactggctatgatttggctgaaaactgtcgtcataatttgcctaaaaagctaaactataccctttaccttttcgctgaagtggcaatcattgctactgatctggccgaggttgtaggcactgccatcgctttacaaattcttttcaaaataccactaacttggggtgtcttattaacggtgctagatgttttggtaattttaatgttctacacaccaaacggccagtccttaaaaaaagttagggttttcgaatttggcgttgggattttggtcattggaacttgcatttgctttgttttggagctgtttaaagtttcaatcccagacaaagctgaattgtttaaagggtttttgccttcaaatatcatttttaaggaacaacaagctctttacatttcattgggtatcttaggtgccactgtgatgcctcattcattatacttgggctcatccattgttaaaccaagattgcacgattacgatttgaagaaatacggtaaggttaatgcccgcccaagtttaagcgctataaaatatacgttaaactatgcgtacgctgaactaatcatttctttgttcttaattgccacctttgttaattccgctattttaattgttgcaggtgctactttatcaggccaacctgaggcagaggatgctgatttgttatctatttacaaattactggtccactacatatctcctgcggcagggttaatctttgcattggccatgttatgttctggtcaatctgccggtatcatctgtacacttgccgggcaaatcgtttctgagggatttttacagtggtctttaccaccttgggccacaagattgtgcaccagattgattgccattgtaccatgtttatttgttactttaaccatgggggaaaagggaatttcagatattttgaatttttctcaagtggtcttgtccttaattttaccaatcgtttccgctcctttaatttattttaccgcaaatagaaagttgatggttgttcatgacgaaaatggtgtggtaagagcacctgccgatgttaacgccattgctgatgaaaccactccattgaactccaagcacagtaaaatagttgattttactaacagtcgtttgttgacctatacctctgttttcgtatgggctttaatcgggagcttgaattgctatttggtgatttcctatctcttaggtgccgacatccatttttaa

SEQ ID NO: 160 - protein, 473 aa, Saccharomyces cerevisiae
MRSYMQILQKFAKFIGPGILVSVAYMDPGNYATSVSGGAQYKYTLLFSIFISNIFAVLLQCLCVKLGTITGYDLAENCRHNLPKKLNYTLYLFAEVAIIATDLAEVVGTAIALQILFKIPLTWGVLLTVLDVLVILMFYTPNGQSLKKVRVFEFGVGILVIGTCICFVLELFKVSIPDKAELFKGFLPSNIIFKEQQALYISLGILGATVMPHSLYLGSSIVKPRLHDYDLKKYGKVNARPSLSAIKYTLNYAYAELIISLFLIATFVNSAILIVAGATLSGQPEAEDADLLSIYKLLVHYISPAAGLIFALAMLCSGQSAGIICTLAGQIVSEGFLQWSLPPWATRLCTRLIAIVPCLFVTLTMGEKGISDILNFSQVVLSLILPIVSAPLIYFTANRKLMVVHDENGVVRAPADVNAIADETTPLNSKHSKIVDFTNSRLLTYTSVFVWALIGSLNCYLVISYLLGADIHF

SEQ ID NO: 161 - DNA, 915 bp, Saccharomyces cerevisiae
atgaatacttcagaactgtcaatagctgaggaaatcgactacgaagctcttccatcacatgctccgctacattcccagttactggcaggagcatttgcaggtataatggagcattctttgatgtttccaatagatgctctgaaaacccgagtgcaggctgcaggattgaataaagctgcctctacagggatgatatctcagatatccaaaatatctacaatggaaggttcgatggctttatggaagggtgttcaatcggtaatactgggggcagggcctgcgcatgcagtatattttggtacatacgagttttgcaaagctcgcctgataagccctgaagatatgcaaactcatcaaccaatgaagaccgcactgagtggtaccattgctaccattgctgcggatgcattgatgaacccctttgacaccgttaaacaaagactacaattggatactaatctaagagtttggaatgttactaagcaaatatatcaaaatgaaggctttgcagcattttactactcctatcccacaacattggccatgaatatcccatttgcagcgttcaatttcatgatatatgaatctgccagcaaattcttcaacccacaaaattcctacaatccattgattcattgtctttgcggtgggataagtggtgcaacatgtgctgcgttaactacaccgttggattgcataaagactgtattacaggttagaggcagcgaaactgtctccatcgaaataatgaaggatgcgaacacttttggtagagcctcaagagccatactggaggttcatggttggaaggggttttggcgaggtttgaaaccaaggatagtggctaatataccagccactgccatttcttggactgcatatgaatgtgctaagcattttttaatgaaaaattga

SEQ ID NO: 162 - protein, 304 aa, Saccharomyces cerevisiae
MNTSELSIAEEIDYEALPSHAPLHSQLLAGAFAGIMEHSLMFPIDALKTRVQAAGLNKAASTGMISQISKISTMEGSMALWKGVQSVILGAGPAHAVYFGTYEFCKARLISPEDMQTHQPMKTALSGTIATIAADALMNPFDTVKQRLQLDTNLRVWNVTKQIYQNEGFAAFYYSYPTTLAMNIPFAAFNFMIYESASKFFNPQNSYNPLIHCLCGGISGATCAALTTPLDCIKTVLQVRGSETVSIEIMKDANTFGRASRAILEVHGWKGFWRGLKPRIVANIPATAISWTAYECAKHFLMKN

SEQ ID NO: 163 - DNA, 498 bp, Saccharomyces cerevisiae
atgcttcctgttataacgagatttgcaaggcctgctctgatggccatcagacctgtgaatgccatgggggttttgagagcgtccagcataacgaaaaggctttatcatcccaaggtcatagagcattatacacatccaagaaacgtcggctcattagataaaaaattgcccaacgtcggcactggtctagtgggtgcgccagcgtgcggtgatgtgatgaggttgcagatcaaagtcaacgactctactggcgttattgaagatgtcaaattcaaaacttttggatgtggctccgccattgcctcctcttcatatatgactgaattggtacaggggatgaccttggacgatgcggcaaaaattaagaacactgaaattgctaaggagttgagcttgcccccagtcaagttgcattgctctatgttagcggaagatgcgatcaaggcagctattaaggactacaaatctaagagaaacactccaaccatgttatcgtaa

SEQ ID NO: 164 - protein, 165 aa, Saccharomyces cerevisiae [sequence omitted]

SEQ ID NO: 165 - DNA, 1659 bp, Saccharomyces cerevisiae
atgggtaaaattgcagagtttctcgggaatccaggtgctaggcctgacgttcatcatagagcacctactgttgactgcaaacagtacgaagaattcggtgattctaacgattacaaaaatgatgatgtggtcagagtagtcagccatagcgatgagagtactgatgacgaactttgtaatgtgaatttaacagaaacaggggcaatcttcacgagtaaaggttttaccgggttaagcaaaggtttcacagataagaccctggatttcctggtacgagtggccggttcgcaggcggttttttttattgtttggatcatcctcataatttgggtggttattggtattgtttataacgcacctttcaattggcaagttgttatgcaggacggacagtctattcaaagttatgtttgggacacactgttgatgagacaacagttgatgagtacgcatgaacaaattttgatctgcggtagattgaagtcgagattggcttccttcaaaaactatctaacaagaagcaccccagaggaagaaaaagcagactgcacagttgaagctaatgaagtcagctctgttgaaaatcatatagacccatctgccattaacggagaactgcctgtggaaaattggtacgaccgtttatctaacgtagcaagtaggtatatgggttcaattgcagcaatggtgatattttggataggtattttcgtttggattggttgcggtgctatcccaaaagatgcgggcaacactccaccttacaccggagaaactacaggtagtaatccaagattgaaaaagttcagtgacgcttggcagatgtatattaacactgcagttgcagtttcccttctaatttgcactactttcttacaaaatataagggctagacatgattatttcacggggaggtttttagttgatatctttgatatggacgagaaaatcgactatcgtataagaaagcattttaacgattttgaaacacctcacccagttgttactattgaatctaaaaaaaggtcgacagggagaaagatgattgattggtatgctgatattattggtactggtattggtgtcctgattggtgtggcagtgttcgccacatggattggtattggttcgccaatgaagtgggatgataattggtggttgattatcggtacatacacaggtttaattgggtttttggacggtttcgttttgagagaagtgtacttccgaatcgttcaacatgaagagaaaaattattctgatgtggctaaagaagaccttgaattattccaagaattaggtattgaatgtcccgaagaatttagtggtaaagctcctgaaattaacactattggttacagaacatcccaatatattaataggatctgctcaactccatggagtgttcttgtatccgtcatcatcatcattggtttaatttgtattgcttccggtttgcgttggagtacaacaggtcaattgattgctaacacgccaactatgattatcgaagaatttttcttgctagttttgttgcaagcacataattgggccgatcgtcaaagaagagtggaggttaccgctttgtacgcacgtaggcgcatacttctatcatacgtagaaaagcgtttcccagaggttatgatgttggaaaaatag

SEQ ID NO: 166 - protein, 552 aa, Saccharomyces cerevisiae
MGKIAEFLGNPGARPDVHHRAPTVDCKQYEEFGDSNDYKNDDVVRVVSHSDESTDDELCNVNLTETGAIFTSKGFTGLSKGFTDKTLDFLVRVAGSQAVFFIVWIILIIWVVIGIVYNAPFNWQVVMQDGQSIQSYVWDTLLMRQQLMSTHEQILICGRLKSRLASFKNYLTRSTPEEEKADCTVEANEVSSVENHIDPSAINGELPVENWYDRLSNVASRYMGSIAAMVIFWIGIFVWIGCGAIPKDAGNTPPYTGETTGSNPRLKKFSDAWQMYINTAVAVSLLICTTFLQNIRARHDYFTGRFLVDIFDMDEKIDYRIRKHFNDFETPHPVVTIESKKRSTGRKMIDWYADIIGTGIGVLIGVAVFATWIGIGSPMKWDDNWWLIIGTYTGLIGFLDGFVLREVYFRIVQHEEKNYSDVAKEDLELFQELGIECPEEFSGKAPEINTIGYRTSQYINRICSTPWSVLVSVIIIIGLICIASGLRWSTTGQLIANTPTMIIEEFFLLVLLQAHNWADRQRRVEVTALYARRRILLSYVEKRFPEVMMLEK

SEQ ID NO: 167 - DNA, 1869 bp, Saccharomyces cerevisiae
atgttgttctactcgttcgtgtggtctgtactggccgctagtgttgctttggcaaagacacataagttaaactataccgcttcttgggtaactgccaatcctgatggattgcatgaaaaaaggatgattggttttaatggcgaatggccacttccagatatccatgttgaaaaaggagatcgtgttgagctttatttgactaacggctttcaagacaatactgctacttctctacatttccatggtcttttccagaatacgagtttggggaaccagcttcaaatggatggtccttctatggtgacacaatgtcccatcgttccgggacaaacatacctgtacaacttcactgtcccagagcaggtaggaacgttctggtaccatgcacacatgggtgcccagtacggtgacggtatgaggggtgcatttatcatccacgatccggaggagcccttcgaatatgatcatgaacgagtcatcactctatcggaccattatcacgaaaattataaaacggttaccaaagagtttctgtcaagatataatccaaccggtgctgaacctattcctcaaaatattctttttaataatacgatgaatgtaactttagattttacacccggtgaaacgtatctcttcaggttcttgaacgttgggctgtttgtatcccagtatatcattcttgaggatcatgaaatgagtatagtagaggtggacggtgtttacgtaaagccaaactttactgattcgatatatctttctgcggggcaaagaatgagtgtgttgattaaagctaaagataaaatgcctacaagaaactacgctatgatgcaaataatggatgagacgatgcttgatgttgtcccacctgagttacaactcaaccaaactatccaaatgaggtatggccactcgttgccggaggcacgcgcattgaacattgaagattgtgacttggaccgcgccacgaatgacttttacctagaacctctgattgagagagacctacttgctcactatgaccaccaaattgtcatggatgtaagaatggtcaacttgggtgatggtgtgaagtatgcatttttcaataatatcacttacgtcacaccaaaggtgcctactttgacaacgttgcttacctcaggaaagcttgcgtcagatcctagaatttatggtgataatatcaatgcgcagttattgaaacataatgatatcatagaggttgttctaaacaattatgattctggcagacatccattccatttgcacggtcataatttccaaatagtccaaaagtcgccagggttccatgttgatgaagcttatgacgaatctgagcaagatgaaatgaccgtcccttataacgaatctgcgccattacaaccgttccctgagaggccgatggtgagagatacagtggttcttgaacctagtggacatgttgtcctgagatttagagctgacaaccctggtgtctggtatttccattgtcatgtagattggcacttacaacaaggtttggcttcggtctttattgaggcacccgttttacttcaggaaagggaaaagcttaatgagaactatctggatatatgcaaagccgctgatattccggtagttggtaatgctgcaggtcattcgaatgattggtttgacttaaaaggattaccaagacaacctgagccactaccaaagggatttactactgaaggatatttggcattgattatttcaaccattatcggtgtctggggcctatattccattgctcagtatggtattggcgaggttatccctaacgatgagaaggtgtaccacacgttaagggaaatcttggctgaaaatgaaatagaggtttctcgcggctaa

SEQ ID NO: 168 - protein, 622 aa, Saccharomyces cerevisiae
MLFYSFVWSVLAASVALAKTHKLNYTASWVTANPDGLHEKRMIGFNGEWPLPDIHVEKGDRVELYLTNGFQDNTATSLHFHGLFQNTSLGNQLQMDGPSMVTQCPIVPGQTYLYNFTVPEQVGTFWYHAHMGAQYGDGMRGAFIIHDPEEPFEYDHERVITLSDHYHENYKTVTKEFLSRYNPTGAEPIPQNILFNNTMNVTLDFTPGETYLFRFLNVGLFVSQYIILEDHEMSIVEVDGVYVKPNFTDSIYLSAGQRMSVLIKAKDKMPTRNYAMMQIMDETMLDVVPPELQLNQTIQMRYGHSLPEARALNIEDCDLDRATNDFYLEPLIERDLLAHYDHQIVMDVRMVNLGDGVKYAFFNNITYVTPKVPTLTTLLTSGKLASDPRIYGDNINAQLLKHNDIIEVVLNNYDSGRHPFHLHGHNFQIVQKSPGFHVDEAYDESEQDEMTVPYNESAPLQPFPERPMVRDTVVLEPSGHVVLRFRADNPGVWYFHCHVDWHLQQGLASVFIEAPVLLQEREKLNENYLDICKAADIPVVGNAAGHSNDWFDLKGLPRQPEPLPKGFTTEGYLALIISTIIGVWGLYSIAQYGIGEVIPNDEKVYHTLREILAENEIEVSRG

SEQ ID NO: 169 - DNA, 1398 bp, Saccharomyces cerevisiae
atggcgtttgaggattatttttctttccagatattcttcattttcttaaggaaatccttagaaattgttgtcattgtttctatcctgttgacgatcgtcaaacaagatctgtctgttgaggacgacagcccgtttgaaggaagttcctcttctgctggtcttccaagtccaaatacgaacacaaacgcagattcgaccactgccttcttacaagcagggccttcagacggtaatgctattggaacgtccgctacggctgctaataataaatcgaggccgctaaatgtggaggaagaagaagaaatttacgagtactctaatgagcttagagaccaggaccgcgagtccgatgaacatacggctgacaacgttaagctatatcagaaattaaaaatacaaattctagcgggcggcgcatttggtttgttgctgtgtatgttaatcgggggtgcgtttgttagtatcttttatcatattggaaccgacttatggacactgagtgaacattattatgaaggtgtcttaagtcttgtcgcgtccgttattatttctgtcatggggttgttttttttaagaatggggaagttaagagagaagttcagagtgaaattagcttctatcatttattcaaaggacaataatttgctgggaaacaaaacccaaaaaggtgtgaaattcagtcaaaagtactccttcttcatattaccatttataacgactttgagagaagggttagaagctgtgtattcaattggaggtatcggtattgaccaaccactatcctcgattcccctctctatggtccttgctactgcaatcagtacggtgttcggtatttttttcttcaggtactcaagttctctttcacttaagatatgccttgtagtcgccacctgcttcctctacttgatcgcggctggtttgttttccaaaggtgtatggcaacttgaattgcaagactacgtcaacaaatgtaacggtcaagacatgagtgaagtagaaaatggacccggttcgtacgacatatctcgttctgtttggcatgttaattgttgcaatggtgaaaaagatggaggttggatgatttttactgccatttttggttggacgaatagtgctaccgtcggctctgtaattagctacaacgcctactggttggtattaaaatacgctttgaagcttctaatgatagaaggaaaatgcggatatatcccatatctacctattagctggcaaaagaaacgtattatgaaaagattaagcattgccaaggcatcgctcgatctcaaacatcatacttctgaactcaactctagcacatcagagccagacagtcaaagacggtccaaagatagttctgtgcccctaataattgatagcagtggttcagcaaattga

SEQ ID NO: 170 - protein, 465 aa, Saccharomyces cerevisiae
MAFEDYFSFQIFFIFLRKSLEIVVIVSILLTIVKQDLSVEDDSPFEGSSSSAGLPSPNTNTNADSTTAFLQAGPSDGNAIGTSATAANNKSRPLNVEEEEEIYEYSNELRDQDRESDEHTADNVKLYQKLKIQILAGGAFGLLLCMLIGGAFVSIFYHIGTDLWTLSEHYYEGVLSLVASVIISVMGLFFLRMGKLREKFRVKLASIIYSKDNNLLGNKTQKGVKFSQKYSFFILPFITTLREGLEAVYSIGGIGIDQPLSSIPLSMVLATAISTVFGIFFFRYSSSLSLKICLVVATCFLYLIAAGLFSKGVWQLELQDYVNKCNGQDMSEVENGPGSYDISRSVWHVNCCNGEKDGGWMIFTAIFGWTNSATVGSVISYNAYWLVLKYALKLLMIEGKCGYIPYLPISWQKKRIMKRLSIAKASLDLKHHTSELNSSTSEPDSQRRSKDSSVPLIIDSSGSAN

SEQ ID NO: 171 - DNA, 3015 bp, Saccharomyces cerevisiae
atgagagaagtgatacttgctgtacatggaatgacatgcagcgcctgtactaatacaatcaatacgcagttacgagctttaaagggtgtaacaaaatgtgatattagtttagtgactaatgagtgccaggtgacatacgataacgaggttaccgccgattctattaaggaaattatagaggattgtggatttgactgtgagatactaagagattctgaaattacagccataagtacgaaggaaggactactgagtgtacaaggtatgacctgtgggtcttgtgtttctacagtcaccaaacaagtggaaggcattgagggtgttgaatcggtagtcgtttccttggtaacggaagagtgccatgttatttatgaaccgtccaagacaacgctagaaaccgccagagaaatgattgaagactgtggatttgactcaaatattattatggatggcaacgggaatgcagacatgaccgaaaaaacggtgatcttgaaagtaactaaggctttcgaggacgaatccccactcatactttcttcagtaagcgaaaggtttcaatttttgttagacctaggtgtaaaatcgatagaaatttctgatgatatgcacacactcaccataaaatactgttgtaacgaactcggcattagagatttattgaggcaccttgagaggaccggatataaattcactgtattttccaatttagataatactacccagttaaggcttctctctaaagaggacgagataagattctggaaaaaaaacagcataaaatccacccttttggctataatatgtatgctattgtatatgattgtccctatgatgtggccaacaattgttcaggaccgcatattcccttacaaagaaacctcctttgttagaggtctgttctacagagatattttgggtgtaatattggcaagctatattcagttcagcgttggtttttacttttacaaggcagcatgggcatctttaaagcacggttcaggaaccatggatacactagtttgtgtttccactacttgtgcatacacattttctgtgttttctttagttcacaatatgttccatccctcaagtactggcaaactcccaaggatcgttttcgacacatcaatcatgatcatttcatatatttccatcgggaaatatttggaaactttagctaaatcacaaacatcaaccgcactttctaaattaattcagctcactccatcggtgtgttcaattatatctgacgtggagcggaatgaaaccaaggaaattcccatagaattattgcaagtgaacgatatagtggagattaaaccagggatgaaaattcctgctgatggcatcataacaagaggtgaatctgaaattgacgagtcgttaatgacaggcgaatccattttggtgcccaagaaaactggttttccggttattgctggttctgttaatggacctggacatttctacttcagaactactaccgttggggaggaaactaaattagcaaatattatcaaggtaatgaaagaagcacaattgagtaaagctcccattcaggggtatgcagattatttagcctctatttttgttccggggatcctaattttggcagtattgactttctttatttggtgttttattttaaacatctcggctaatcctcccgtcgctttcaccgcaaatactaaggctgataatttttttatttgcttacaaactgctacttctgttgtcatcgtcgcatgcccatgtgcattgggacttgccacgccgactgctataatggtgggtacaggggttggagctcagaatggtgtcttaataaagggcggagaagtattggaaaaattcaatagtattactacttttgtttttgataaaacaggtaccttaactacaggttttatggttgtgaaaaagttccttaaagattcaaattgggttggaaacgtggatgaagacgaagttctcgcctgtataaaagcaacggaatccattagtgaccatccagtttcgaaagcaattatacgttattgtgatggtttgaactgtaataaggctttaaatgccgttgttttagaaagcgaatacgtgcttggaaagggaatagtctcaaagtgtcaagttaatggaaatacttatgatatttgtattgggaacgaggcgctgattttggaggatgcattaaaaaaatccggatttattaacagtaatgtcgaccaaggaaacactgtatcatacgtatcagtaaacgggcatgtgtttggcttgttcgagattaatgatgaagttaaacatgattcttacgcaacagttcagtatctacaaagaaatggatatgaaacgtatatgattactggcgataataactcagcagcaaaaagagtcgctagagaagtaggtataagcttcgaaaatgtttacagcgatgtgtcacccacaggcaaatgtgatctcgtgaaaaaaattcaagataaagaaggtaataacaaggttgctgttgttggcgatggcattaacgacgctcccgctttagcactgagtgatctaggtattgccatttcaacaggtacggagattgctattgaagcagctgatattgttatactgtgcggtaatgatctgaatactaatagtttgagaggactggccaacgccatcgatatttcactaaaaacgttcaaaagaataaagctgaatttgttctgggcactttgctataatatattcatgattccgattgctatgggtgtgctcattccttggggcataactcttcctccaatgctcgccggtttagcgatggcattcagctcggtcagtgtcgttctaagttcattgatgttgaagaagtggactccaccggatattgaatcacatgggatttcagatttcaagtccaaattttcgattgggaatttttggtcaaggcttttttctacgcgggctattgcaggtgagcaagacatagaatcacaggccggactaatgtcaaacgaagaagtcttgtaa

SEQ ID NO: 172 - protein, 1004 aa, Saccharomyces cerevisiae
MREVILAVHGMTCSACTNTINTQLRALKGVTKCDISLVTNECQVTYDNEVTADSIKEIIEDCGFDCEILRDSEITAISTKEGLLSVQGMTCGSCVSTVTKQVEGIEGVESVVVSLVTEECHVIYEPSKTTLETAREMIEDCGFDSNIIMDGNGNADMTEKTVILKVTKAFEDESPLILSSVSERFQFLLDLGVKSIEISDDMHTLTIKYCCNELGIRDLLRHLERTGYKFTVFSNLDNTTQLRLLSKEDEIRFWKKNSIKSTLLAIICMLLYMIVPMMWPTIVQDRIFPYKETSFVRGLFYRDILGVILASYIQFSVGFYFYKAAWASLKHGSGTMDTLVCVSTTCAYTFSVFSLVHNMFHPSSTGKLPRIVFDTSIMIISYISIGKYLETLAKSQTSTALSKLIQLTPSVCSIISDVERNETKEIPIELLQVNDIVEIKPGMKIPADGIITRGESEIDESLMTGESILVPKKTGFPVIAGSVNGPGHFYFRTTTVGEETKLANIIKVMKEAQLSKAPIQGYADYLASIFVPGILILAVLTFFIWCFILNISANPPVAFTANTKADNFFICLQTATSVVIVACPCALGLATPTAIMVGTGVGAQNGVLIKGGEVLEKFNSITTFVFDKTGTLTTGFMVVKKFLKDSNWVGNVDEDEVLACIKATESISDHPVSKAIIRYCDGLNCNKALNAVVLESEYVLGKGIVSKCQVNGNTYDICIGNEALILEDALKKSGFINSNVDQGNTVSYVSVNGHVFGLFEINDEVKHDSYATVQYLQRNGYETYMITGDNNSAAKRVAREVGISFENVYSDVSPTGKCDLVKKIQDKEGNNKVAVVGDGINDAPALALSDLGIAISTGTEIAIEAADIVILCGNDLNTNSLRGLANAIDISLKTFKRIKLNLFWALCYNIFMIPIAMGVLIPWGITLPPMLAGLAMAFSSVSVVLSSLMLKKWTPPDIESHGISDFKSKFSIGNFWSRLFSTRAIAGEQDIESQAGLMSNEEVL

SEQ ID NO: 173 - DNA, 2160 bp, Saccharomyces cerevisiae
atgttgttggtacatattatatctttccttctgttcttccagctttcggccgcaaaggccccacccagtaaaacgtctctaataaatactcatgagagaaggtcgatatattcatgctacgttggtttacgtaaagaaacatgggggttcaatgggtccgctatatgtcggtatgaaccagcaatccaatcgatgctttactgtctttacgaagacacgcatgagaaagggtattcaaataaaactttggagaaaggttttgaagaaatgagacaattttgctatacaccaaagtttttgaacatgactgatgccgagttttacacctcattggataatggaacatactatatacaagatcaacctaaagctggcatcaatatcacttatcctatcagactgaacactacactaagaaaagcatactatgatgcatactatggttactactataaccatgacattccgtattatttcgggggcattatctgtgcatactttgtgggtgtcatgttgcttgcaggtttaattcgttttttgaattataccccaataaaaaagattatgtttcagcaaaagctagtcaattacgtgagaggttatactactctacccactctttatgaaaagcatgcagagcccttctcgtacttaaaagtgataacaggctatcttcctactaggtttgaaacgttggttattttaggctacctcatacttcataccattttcatggcctacaaatatcaatatgatccataccacatcatatttgccgctcatagagcagaagtggcacattttgttgcgtacagaagcggtatactttcttttgcacacctgccactcattgttttatttgcgggaagaaataactttctccaacttatttctggcttgaagcatacctcattcattgtgttccataagtggctgggaagaatgatgtttcttgatgcaataattcatgctgccggctttacgaactattatttgtattataaaaaatggaatacggttagattaagagtctactggaaattcggtattgctaccacctgtttagcgggaatgttaattttcttttccatcgcagcatttagaagacactactatgaaacgtttatggccctccatatagtattcgcagcactatttctctatacttgttgggagcatgttactaacttcagcggtatcgaatggatttacgcggcaatagcaatttggggagttgatagaattgtacgtatcaccagaattgcactcttaggatttcctaaagcagatctacaactggttggatctgatttggtccgtgtaacggttaaaaaaccaaagaagttttggaaggcaaaaccaggccaatacgttttcgtttccttcttgcgtccattgtgcttctggcagtcgcatccatttacagtgatggattcttgcgtaaacgatagagaattggtcatcgttctgaaagcaaagaaaggtgtgacaaaactggtaagaaactttgttgaacgtaaaggcggcaaggcatccatgagattagctatcgaaggcccttatggctccaagtccaccgcccatcgctttgataatgtattattgttggcaggtggctcagggcttcccggtccaatttctcatgcccttgaattaggaaagacaacagctgcaagcggtaaaaactttgtacagttagtcatagcagtaagaggactagacatgctcaacgcgtgtaagaaagaactaatggcattaaagggcttgaatgttcaagttcacatttataattctaagcaagagctagcttcggctgaaaaaatttcctcaaatgaagtcaaaaacggtgaaacgacagcagagaaggccccatctagtctaagcaattcagaaaaagctccttctgaaagtgaaaatacagaactacctctttccctgaatgacacgtctatctccgatttagaatttgccactttccatgttggaaggccaaatgttgaagaaatactaaatgaatctgttaaccattctggttcacttgccgtcgtatgttgcggaccacctattttcgtcgacaccgctagaaatcaaactgccaaagctgttatcagaaacccatcaagaatgattgaatacttggaggaataccaagcctggtga

SEQ ID NO: 174 - protein, 719 aa, Saccharomyces cerevisiae
MLLVHIISFLLFFQLSAAKAPPSKTSLINTHERRSIYSCYVGLRKETWGFNGSAICRYEPAIQSMLYCLYEDTHEKGYSNKTLEKGFEEMRQFCYTPKFLNMTDAEFYTSLDNGTYYIQDQPKAGINITYPIRLNTTLRKAYYDAYYGYYYNHDIPYYFGGIICAYFVGVMLLAGLIRFLNYTPIKKIMFQQKLVNYVRGYTTLPTLYEKHAEPFSYLKVITGYLPTRFETLVILGYLILHTIFMAYKYQYDPYHIIFAAHRAEVAHFVAYRSGILSFAHLPLIVLFAGRNNFLQLISGLKHTSFIVFHKWLGRMMFLDAIIHAAGFTNYYLYYKKWNTVRLRVYWKFGIATTCLAGMLIFFSIAAFRRHYYETFMALHIVFAALFLYTCWEHVTNFSGIEWIYAAIAIWGVDRIVRITRIALLGFPKADLQLVGSDLVRVTVKKPKKFWKAKPGQYVFVSFLRPLCFWQSHPFTVMDSCVNDRELVIVLKAKKGVTKLVRNFVERKGGKASMRLAIEGPYGSKSTAHRFDNVLLLAGGSGLPGPISHALELGKTTAASGKNFVQLVIAVRGLDMLNACKKELMALKGLNVQVHIYNSKQELASAEKISSNEVKNGETTAEKAPSSLSNSEKAPSESENTELPLSLNDTSISDLEFATFHVGRPNVEEILNESVNHSGSLAVVCCGPPIFVDTARNQTAKAVIRNPSRMIEYLEEYQAW

SEQ ID NO: 175 - DNA, 471 bp, Saccharomyces cerevisiae
atgttcgccagactcgctaatcctgcccacttcaagcctctcacgggctcccacataacaagagctgccaaaagactttaccatcctaaggtaattgaccactacacaaacccaagaaacgttgggtccatggataagtccttagctaatgtcggcacaggaatcgtgggcgcccctgcgtgtggtgatgtgataaaactacaaatacaggtgaatgataaatcgggtattatcgagaacgttaagttcaagaccttcgggtgtgggtctgccatcgcttcctcctcctacatgaccgagctggtacgcggtatgtcacttgatgaggccgttaaaattaaaaacacggaaatcgcgaaggagctaagtcttcctccagtaaaactgcattgttccatgcttgcagaagacgctatcaaggcggcaatcaaggactacaaaacaaagaggaacccctccgttttgcattga

SEQ ID NO: 176 - protein, 156 aa, Saccharomyces cerevisiae
MFARLANPAHFKPLTGSHITRAAKRLYHPKVIDHYTNPRNVGSMDKSLANVGTGIVGAPACGDVIKLQIQVNDKSGIIENVKFKTFGCGSAIASSSYMTELVRGMSLDEAVKIKNTEIAKELSLPPVKLHCSMLAEDAIKAAIKDYKTKRNPSVLH

SEQ ID NO: 177 - DNA, 954 bp, Saccharomyces cerevisiae
atggaggacagtagcaatacaatcataccctcacccactgacgtgggggcgctagcaaacagaatcaactttcaaaccagagatgcccacaataaaatcaataccttcatgggcataaagatggccatcgccatgagacatggctttatatacagacagggtattctggcgtactattatgtgttcgatgccatcgagcaagagatagatcgcctactgaatgaccccgtaacggaggaggagctgcaaacttcgaccattctgaagcagttttggctcgaagattttagaagatctacgcagatctataaggacctgaagctgctatactcaaacacgtttaaaagcacagaatcattaaacgaattcctggctacgttccagaagccaccgctactacagcagtttatcaataacatccacgaaaacatacacaaggagccatgcaccattctttcttactgtcacgttctgtacttggcgcttttcgccggcggcaagctaatacgatcgaatttgtacagaagactggggctcttccccaacttcgagaagctatcacagaaggaactggtcaaaaagggcacaaacttcttcaccttcagcgatctgggtcccactgaagaaacacgcttgaaatgggaatacaagaagaactatgagctggccaccaggacggaattgaccgaagcacaaaagttgcagatcattagcgtcgcagaaggcatttttgattggaacttcaacatcgttgcagaaattggagagttgaatcgtcgcgagttaatgggcaagttcagcttcaagtgtattacgtacttgtacgaagaatggatgttcaacaaggattctgctactagaagagcactccacacggtcatgctgctggtgctttctattatcgcgatctgggttctttacttcttggtaaagagttttcttagcatagtataa

SEQ ID NO: 178 - protein, 317 aa, Saccharomyces cerevisiae
MEDSSNTIIPSPTDVGALANRINFQTRDAHNKINTFMGIKMAIAMRHGFIYRQGILAYYYVFDAIEQEIDRLLNDPVTEEELQTSTILKQFWLEDFRRSTQIYKDLKLLYSNTFKSTESLNEFLATFQKPPLLQQFINNIHENIHKEPCTILSYCHVLYLALFAGGKLIRSNLYRRLGLFPNFEKLSQKELVKKGTNFFTFSDLGPTEETRLKWEYKKNYELATRTELTEAQKLQIISVAEGIFDWNFNIVAEIGELNRRELMGKFSFKCITYLYEEWMFNKDSATRRALHTVMLLVLSIIAIWVLYFLVKSFLSIV

SEQ ID NO: 179 - DNA, 690 bp, Saccharomyces cerevisiae
atggatggaaatcataggtttactccagattccaaagaatttaatactgttgtaaaaagtaaagagtcttccactggcagaaatccgtatcagactccgcccttagagcacaacggtactcatcatcagacaaattacagcagaaagaaaacaaatctagcaattatcatatcgaatttcttgtccgagatcagtcggcctctttcaaatggcaaaatcaataattctacccacaacattttaaaatttctaaatgaagtgcttaagagatcgaagtgcagtaaagaaaacgctgtgttagccactttctactttcaaaagattcaccaatccagaggtgtccgggatgagtcctcattgcctgaattctcgcactgttcccgcagaatttttctctgctgtcttattctatcgcacaaatttttgaacgacaacacttactcgatgaaaaattggcaaattataagtgggctccatgcaaaggatctatctctaatggaaagatggtgtctgggtaagctgaattatgagctggccattccatatgacgagtttttgctatgggaaacgaacactttaatgaaagcgaaattgcgcgtcggaactcccgccaacgctccggtgaagagacccagagaatcagacaatgattatgatgcaaattcttggaaacagattaaatcttgttaa

SEQ ID NO: 180 - protein, 229 aa, Saccharomyces cerevisiae
MDGNHRFTPDSKEFNTVVKSKESSTGRNPYQTPPLEHNGTHHQTNYSRKKTNLAIIISNFLSEISRPLSNGKINNSTHNILKFLNEVLKRSKCSKENAVLATFYFQKIHQSRGVRDESSLPEFSHCSRRIFLCCLILSHKFLNDNTYSMKNWQIISGLHAKDLSLMERWCLGKLNYELAIPYDEFLLWETNTLMKAKLRVGTPANAPVKRPRESDNDYDANSWKQIKSC

SEQ ID NO: 181 - DNA, 411 bp, Saccharomyces cerevisiae
atgtcctctgtggaatcttcccccatctcgcgctatgaagacgaggtcttccctctttcgttttcaaacgttgctttcgagccccctatgctctcgcatagcccggacagatcgacttatgccgatgacttttctcaatcttaccagcaagaattgctaacttttccgctatcgtacccgattgtcgatgagtcagaatgcacgcacactaaagataagacggacagcaacataataacgagtactgaagacgattgcatgttcgatatggaatttaacggcaacgccgccagtgcagttgctgctgctagtaaggaatctaactctgcctctgggtttgcctttgcaagtaacgatgcctttgccaatgtcgcacaacagaactacagactgtggttgtcatcggtatga

SEQ ID NO: 182 - protein, 136 aa, Saccharomyces cerevisiae
MSSVESSPISRYEDEVFPLSFSNVAFEPPMLSHSPDRSTYADDFSQSYQQELLTFPLSYPIVDESECTHTKDKTDSNIITSTEDDCMFDMEFNGNAASAVAAASKESNSASGFAFASNDAFANVAQQNYRLWLSSV

SEQ ID NO: 183 - DNA, 900 bp, Saccharomyces cerevisiae
atgaaactttctaaattatcgatcttaacctccgccttagccacgtctgcattggccgctcctgccgttgttactgtcactgaacacgcccatgaggctgcagtcgttactgtgcaaggcgtagtttatgtcgaaaacggccaaacacgtacaacttacgaaacactagctcctgcttccactgccactccaacttctacagctacagctttggttgctccccctgtcgctccttcctctgcttccagcaattccgatgtggtcttgtctgctttgaagaacttagcctctgtttggggtaaaactaccgattcaacgaccacgttgacatcttctgaatctacatcgcaatcgttggctcaagctactacgacttctacacccgctgctgcttccaccacttccacacccgctgctaccaccaccacttctcaagccgctgctactagctcagcatcgtcttcggatagtgacctgtcagattttgcctcttctgtgttggctgaacacaacaagaagagagctttgcacaaggacacaccagctttgtcctggtccgatactttggcctcctacgctcaagactatgctgacaactatgattgctccggcactttgacccattctggcggtccatacggtgaaaacttggctttgggttatgacggcccagctgccgtcgacgcttggtacaatgaaatttccaactacgacttctcgaatccaggcttttcaagtaacactggccactttactcaagtcgtttggaagtccaccacccaagttggttgtggcatcaaaacctgtggcggtgcatggggtgactatgtcatctgtagttacgaccccgcaggaaactacgaaggcgaatacgccgataatgtcgagcccctagcttaa

SEQ ID NO: 184 - protein, 299 aa, Saccharomyces cerevisiae
MKLSKLSILTSALATSALAAPAVVTVTEHAHEAAVVTVQGVVYVENGQTRTTYETLAPASTATPTSTATALVAPPVAPSSASSNSDVVLSALKNLASVWGKTTDSTTTLTSSESTSQSLAQATTTSTPAAASTTSTPAATTTTSQAAATSSASSSDSDLSDFASSVLAEHNKKRALHKDTPALSWSDTLASYAQDYADNYDCSGTLTHSGGPYGENLALGYDGPAAVDAWYNEISNYDFSNPGFSSNTGHFTQVVWKSTTQVGCGIKTCGGAWGDYVICSYDPAGNYEGEYADNVEPLA

SEQ ID NO: 185 - DNA, 939 bp, Saccharomyces cerevisiae
atgtcatttcaccaacagttctttaccttgaataatggaaataaaatccccgcaatcgccatcattgggacaggtactagatggtataaaaacgaagaaacggatgctaccttttcgaacagtttggtcgaacagattgtttatgctctgaagttacctggcattattcacattgatgctgctgagatctacagaacatatccagaagttgggaaggcacttagcctcaccgaaaaaccaagaaatgcaatattcttgacagacaagtactcacctcaaatcaagatgtcagattccccagcggatggactagatttagctttgaagaagatgggcactgactatgtcgatctataccttttgcatagcccatttgtttccaaagaggtcaacgggttaagtttggaggaagcctggaaggacatggagcaattgtacaaatcaggtaaagctaaaaatatcggtgtttccaactttgctgtggaagacttgcaaagaattctgaaagttgcggaagtcaagccccaagttaatcaaattgagttcagtcccttcttgcagaatcaaacaccagggatctacaaattttgccaagaacatgatatattggtagaagcatactcgccactaggtcccttacaaaagaaaacagcacaagatgactctcaaccgtttttcgaatacgtgaaagagttatccgagaaatatatcaaatctgaagcccaaattatcctacgttgggtgaccaaacgtggcgtgttgcctgtaaccacctcttccaaacctcaaagaatttctgacgcgcaaaatttattctctttcgacttgacggctgaggaagtcgataagataacggagttgggcttggaacatgaaccgctaagattgtattggaataaattgtacggtaaatacaactacgctgctcaaaaagtataa

SEQ ID NO: 186 - protein, 312 aa, Saccharomyces cerevisiae
MSFHQQFFTLNNGNKIPAIAIIGTGTRWYKNEETDATFSNSLVEQIVYALKLPGIIHIDAAEIYRTYPEVGKALSLTEKPRNAIFLTDKYSPQIKMSDSPADGLDLALKKMGTDYVDLYLLHSPFVSKEVNGLSLEEAWKDMEQLYKSGKAKNIGVSNFAVEDLQRILKVAEVKPQVNQIEFSPFLQNQTPGIYKFCQEHDILVEAYSPLGPLQKKTAQDDSQPFFEYVKELSEKYIKSEAQIILRWVTKRGVLPVTTSSKPQRISDAQNLFSFDLTAEEVDKITELGLEHEPLRLYWNKLYGKYNYAAQKV

SEQ ID NO: 187 - DNA, 636 bp, Saccharomyces cerevisiae; identical to SEQ ID NO: 147

SEQ ID NO: 188 - protein, 211 aa, Saccharomyces cerevisiae; identical to SEQ ID NO: 148

SEQ ID NO: 189 - DNA, 32 bp, Artificial Sequence
  Primer oGV3432
ttattcggtaccatgaagcacgagctacagac

SEQ ID NO: 190 - DNA, 34 bp, Artificial Sequence
  Primer oGV3433
gaataacctaggtgattgaaaaaagccgtgaggt

SEQ ID NO: 191 - DNA, 1205 bp, Artificial Sequence
  Cassette for introducing a deletion in K. marxianus URA3
caaccactgcagccagcagttaaagcaccaacaagtgacgaattctgattggaaagaccattctgctttacttttagagcatcttggtcttctgagctcattatacctcaatcaaaactgaaattaggtgcctgtcacggctctttttttactgtacctgtgacttcctttcttatttccaaggatgctcatcacaatacgcttctagatctattatgcattataattaatagttgtagctacaaaaggtaaaagaaagtccggggcaggcaacaatagaaatcggcaaaaaaaactacagaaatactaagagcttcttccccattcagtcatcgcatttcgaaacaagaggggaatggctctggctagggaactaaccaccatcgcctgactctatgcactaaccacgtgactacatatatgtgatcgtttttaacatttttcaaaggctgtgtgtctggctgtttccattaattttcactgattaagcagtcatattgaatctgagctcatcaccaacaagaaatactaccgtaaaagtgtaaaagttcgtttaaatcatttgtaaactggaacagcaagaggaagtatcatcagctagccccataaactaatcaaaggaggatgtcgaatcaccaatgcacacggtgtgactggtgcgggcattgttgctggtttgaagcaaggtgccgaggaagttacgaaagaacctagagggttgttaatgcttgccgagttatcgtccaaggggtctctagcgcacggtgaatacactcgtgggaccgtggaaattgccaagagtgataaggactttgttattggatttattgctcaaaacgatatgggtggaagagaagagggctacgattggttgatcatgacgccaggtgttggtcttgatgacaaaggtgatgctttgggacaacaatacagaactgtggatgaagttgttgccggtggatcagacatcattattgttggtagaggtcttttcgcaaagggaagagatcctgtagtggaaggtgagagatacagaaaggcgggatgggacgcttacttgaagagagtaggcagatccgcttaagagttctccgagaacaagcagaggttcgagtgtactcggatcagaagttacaagttgatcgtttatatataaactatacagagatgttagagtgtaatggcattgcgtcggatcctgtgag

SEQ ID NO: 192 - DNA, 3855 bp, Artificial Sequence
  Plasmid pGV1799
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattcgagctcggtacccggggatccgacgcaatgccattacactctaacatctctgtatagtttatatataaacgatcaacttgtaacttctgatccgagtacactcgaacctctgcttgttctcggagaactcttaagcggatctgcctactctcttcaagtaagcgtcccatcccgcctttctgtatctctcaccttccactacaggatctcttccctttgcgaaaagacctctaccaacaataatgatgtctgatccaccggcaacaacttcatccacagttctgtattgttgtcccaaagcatcacctttgtcatcaagaccaacacctggcgtcatgatcaaccaatcgtagccctcttctcttccacccatatcgttttgagcaataaatccaataacaaagtccttatcactcttggcaatttccacggtcccacgagtgtattcaccgtgcgctagagaccccttggacgataactcggcaagcattaacaaccctctaggttctttcgtaacttcctcggcaccttgcttcaaaccagcaacaatgcccgcaccagtcacaccgtgtgcattggtgattcgacatcctcctttgattagtttatggggctagctgatgatacttcctcttgctgttccagtttacaaatgatttaaacgaacttttacacttttacggtagtatttcttgttggtgatgagctcagattcaatatgactgcttaatcagtgaaaattaatggaaacagccagacacacagcctttgaaaaatgttaaaaacgatcacatatatgtagtcacgtggttagtgcatagagtcaggcgatggtggttagttccctagccagagccattcccctcttgtttcgaaatgcgatgactgaatggggaagaagctcttagtatttctgtagttttttttgccgatttctattgttgcctgccccggactttcttttaccttttgtagctacaactattaattataatgcataatagatctagaagcgtattgtgatgagcatccttggaaataagaaaggaagtcacaggtacagtaaaaaaagagccgtgacaggcacctaatttcagttttgattgaggtataatgagctcagaagaccaagatgctctaaaagtaaagcagaatggtctttccaatcagaattcgtcacttgttggtgctttaactgctggctgcaggcatgcaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 193 - DNA, 32 bp, Artificial Sequence
  Primer oGV394
caaccactgcagccagcagttaaagcaccaac

SEQ ID NO: 194 - DNA, 32 bp, Artificial Sequence
  Primer oGV395
ctcacaggatccgacgcaatgccattacactc

SEQ ID NO: 195 - DNA, 7273 bp, Artificial Sequence
  linear fragment, KM_AFT, Ll_ilvD_coSc & G418
caccagtaaaacatacgcatacacatacacacatagagcaagcaagcaggctagcaaccaggaaaggctgccagtgactgctactgggtgtctaagaaccgtagggcggattattgttgcggtggttggttgcgggtggttatgcgatggtacggtgcagaatcgtacggtgttggttatggaattagtatgggtatgtgatatgtggtaatatgtgatattgggttattgtgatttggaatactgaatatcgaatatgggatatggaatatggccatggcatggtatggtatgggatgggagtattctattttattttattttattctggttcctgcgtttagggtagggtaggaagaaggtgagtgcttttgtatataagtggagtgtctggatcagttttgtggattgtgaatgttgttagtttcccctttaatgtatatttgtattatttgcttttgagtactcaataaccaagcacaactactagttttaaaggatccatcctcttaaacagtacaatcgcaaagaaaagctccacacccaaaccaaataattgcaatggagtttaagtataacggcaaagttgaatctgttgaactgaataagtacagcaaaacgttgacacaagatcccacacaacccgccacacaggcaatgtattacggcatcgggtttaaagacgaagatttcaagaaagctcaagtgggtatagtgtcgatggactgggatggaaatccatgcaacatgcatttaggaacccttggatcaaagattaaaagctcagtaaatcagacagatggtctgatcggcttacaatttcatacgataggagtttctgatgggatagcaaatggaaagttgggaatgagatactcccttgtttccagagaagttatagctgactctattgaaaccaacgctggcgctgaatactatgatgcaattgtagccatcccaggttgtgacaaaaatatgccaggttctattattggtatggcaagacttaataggccaagcattatggtgtatggaggaacaatagaacacggtgaatataaaggtgagaaattgaacatcgtatcggcttttgaatctctaggccagaaaattaccggcaatatctctgatgaagattatcacggtgttatttgtaatgctattcctggtcaaggggcatgtggggggatgtacacagctaataccttagctgccgctatcgaaacactaggtatgtcattgccgtattcttcttcgaaccctgcagtatctcaagaaaaacaagaagaatgtgatgagattggattagccattaagaatcttttggaaaaagacatcaagcctagtgatataatgactaaggaggcgttcgagaacgctattaccattgtgatggtcttggggggtagtactaatgctgtcttgcatattattgcaatggctaacgcgataggtgtcgaaataactcaggatgacttccaaagaattagtgacattactccagtactaggtgattttaaaccttcaggtaaatatatgatggaagatttgcataaaattggaggcttgccagcagtgcttaagtaccttctaaaggaaggaaaattgcatggtgactgccttactgtgacgggtaaaacattagccgagaatgtcgagactgccctagacttggatttcgactcacaagatatcatgaggccactaaagaatcctatcaaggccaccggccacttgcagattctgtacggtaatttagctcaagggggttccgtagcaaaaattagcggtaaagaaggagagttcttcaaaggcactgccagagtctttgatggtgaacaacattttatcgacggcatagaatctggtcgtttgcatgctggagatgtagcggtaattaggaatataggtcccgtcggcggacctggtatgcccgaaatgctgaagcctacatcagcattaattggtgcgggtttagggaaaagttgcgcgttaattacggatggtagattctccggtggcactcacggttttgttgtcggccatattgtgcctgaagccgttgagggtggactaatcggcttagttgaagatgacgatataatagagatagatgcagtcaacaactctatatccctgaaagtttccgatgaagaaatcgcaaagagaagagctaattatcagaagccaactccgaaagccaccaggggagttttggcaaaattcgctaaattaacccgtcctgcatcggaagggtgtgttactgatctgtaatgtttaaagattacggatatttaacttacttagaataatgccatttttttgagttataataatcctacgttagtgtgagcgggatttaaactgtgaggaccttaatacattcagacacttctgcggtatcaccctacttattcccttcgagattatatctaggaacccatcaggttggtggaagattacccgttctaagacttttcagcttcctctattgatgttacacctggacaccccttttctggcatccagtttttaatcttcagtggcatgtgagattctccgaaattaattaaagcaatcacacaattctctcggataccacctcggttgaaactgacaggtggtttgttacgcatgctaatgcaaaggagcctatatacctttggctcggctgctgtaacagggaatataaagggcagcataatttaggagtttagtgaacttgcaacatttactattttcccttcttacgtaaatatttttctttttaattctaaatcaatctttttcaattttttgtttgtattcttttcttgcttaaatctataactacaaaaaacacatacataaactaaaaactagtatgggtaaggaaaagactcacgtttcgaggccgcgattaaattccaacatggatgctgatttatatgggtataaatgggctcgcgataatgtcgggcaatcaggtgcgacaatctatcgattgtatgggaagcccgatgcgccagagttgtttctgaaacatggcaaaggtagcgttgccaatgatgttgcagatgagatggtcagactaaactggctgacggaatttatgcctcttccgaccatcaagcattttgtccgtactcctgatgatgcatggttactcaccactgcgatccccggcaaaacagcattccaggtattagaagaatatcctgattcaggtgaaaatattgttgatgcgctggcagtgttcctgcgccggttgcattcgattcctgtttgtaattgtccttttaacagcgatcgcgtatttcgcctcgctcaggcgcaatcacgaatgaataacggtttggttgacgcgagtgattttgatgacgagcgtaatggctggcctgttgaacaagtctggaaagaaatgcataagcttttgccattctcaccggattcagtcgtcactcatggtgatttctcacttgataaccttatttttgacgaggggaaattaataggttgtattgatgttggacgagtcgggatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaactcaactcaagacgcacagatattataacatctgcataataggcatttgcaagaattactcgtgagtaaggaaagagtgaggaactatcgcatacctgcatttaaagatgccgatttgggcgcgaatcctttattttggcttcaccctcatactattatcagggccagaaaaaggaagtgtttccctccttcttgaattgatgttaccctcataaagcacgtggcctcttatcgagaaagaaattaccgtcgctcgtgatttgtttgcaaaaagaacaaaactgaaaaaacccagacacgctcgacttcctgtcttcctattgattgcagcttccaatttcgtcacacaacaaggtcctagcgacggctcacaggttttgtaacaagcaatcgaaggttctggaatggcgggaaagggtttagtaccacatgctatgatgcccactgtgatctccagagcaaagttcgttcgatcgtactgttactctctctctttcaaacagaattgtccgaatcgtgtgacaacaacagcctgttctcacacactcttttcttctaaccaagggggtggtttagtttagtagaacctcgtgaaacttacatttacatatatataaacttgcataaattggtcaatgcaagaaatacatatttggtcttttctaattcgtagtttttcaagttcttagatgctttctttttctcttttttacagatcatcaaggaagtaattatctactttttacaacaaatataaaacaagatggcgattaagcaagagatgggtgcgtctagcggtttggacccgctggaccctctggacccgctttcgaatgcggagttttggcacgcatctccttcttttgagatgatgaattcgccgaaggtgtcacctgcgagcactgtgatgacgcatacgcctagtgtgggcgggcagcagagtagcaacagcgaggtttcgtacaataatgttctgagtgagaatgcgatagaggcattgcagaagcaacaggaccagaacaagttgatccacttggacccgattcctgacttcaaggacaagagcgaggtgaagccgtggctccagaagatattttatccgcaggggatcgagattgtgattgagcggtcggacagcatgaagattgtgttcaagtgcaaggctgtgaagaaggcgaggagcggggttgcggctgcggcggccgcggcgtcttcgggttctggggtagcggggagttccggccacttcctagggtgtgcgtacgtgggcatgaacacgaatccgatgttgaataagggttcgagtaagaagaaggatggcagcggtaataatgccaggtgcaaggacgagaagtgcggcggcgatgggtcgtgtgaaaatagcggcgctaacgtcgacgctaatgctgcggaaaatgctaatgctagtaatagtaccacatccacgggcaaaaagaagagggtcactggtccatacaactcgtgtcccttcagagtgcgagctactttctcgttgaaaaggaagaagtggaacatcgtggtgattaacaacgtgcacacccacccgctacggttcaatcccgacagcgaggactacaaaaaatttaaaaagggtctatacgacagcggcgatatcgagacggtcaagaaattcgacgagctcgaatacagaactaaatcgaacctgcctatcgatttgagccctatcccatgtgactgtggtctaacacaggaaatccagtcctttaatatcgtccttccaacaacaaacattatagcatcaaccagcagagctggttcttctgatgcaaacactgtgtcaaagccaaagaagtgtaaaaactctttgaagaagaaatcaaaaaaattgaggctaaagaatacaaaacaaaagttgcaacaggatatcgaaagcaacagcgctcatacttccgctacaggaacgccattaggaaatgtaccaaatacactgaacctccaatttgacgtcaacatggacttgggtgtacagtccacttctggatcaaatatgaattcaagcgtggtattaacccctcaagaaaacatatattcgcatgatttcttccccaacacagcttcatcgcaacgtaatgactcaccaaacttttcaaatctaaacccaagctactttaacactgagaatgaaattgacttcacggagctatttagcaaaccattacctcatttcaaaaacaatcagcaacctgtaccccaatcacaggatgctattccactctcgttttctcataaaccatcaaacagtggtattccggacacccatcattctcaggcccaaggcaggcatatgttataccagaacgttgattctacaccatctactcattcatcacctagtatgaatgtaatgaccacaggaaagaattctatgacaatcacaccagctcttaacacagctacagcagcaacaggacccactcagagttccgtgccattgtactcatcggatatatctaaggaacaaattcaagatttcgttgacatgaatcaaattttcggcacctccgaatattctaaagaccgtaattctaactcaaataccccgaactctgtgatcccaggacggtcattaaactttcaacattctagattaccaacttcaaatcaacatcagaatcaaagtgctatttgtgaaataaataactatgatgtctgtgcaaatgactttggacaatgtggcggtgtcggcgctggtgtcgaaaccaattcacatagtaatactaacagtattactttgacgactagttctatgggtaatggtatcaactcgagcgtccatggttatgatattccaattaaaacagagttaacttcaaacccacaggagtatatctctaatgtactgaatacggattttaacgaacttaaactttcccaagatgaacaacatcagcaacaaggtggcatgaacaacctcggttctcaatcaaattacaactaccagttaatgttcgatgaggagttaaatcaacctcaacaaacaacgcataaccctcacaccctgtgggaagaacctcatggattccttcagtgacatatagatgaaatcaaacttagacgtatctctcgtccattttcattacattttcatctttcttcattaattatatactgaacatatacgcatctatacaattttgactttttaaagaagaaaaagaaaacaatagtatacattcttttttctacttttgttacagataaaaaatcgttcttattatattacatatatcggtgctaagatcaggattttttcatgttccttccccctgttatttcacatcatccttttgccggtagattaggctggtgtaaatagtagtgcttttctcatacatacaagacatacgtgaagataagtcccattttctctccctctgtcattaattttgaaagttcgttgagcactcatgaaaactgcgtccttttgtttttttgatctgaagtaaatatgtgtgagcaagataagcacacaaagaataaaaccatcgaagtatcctttcttctttgttgtgattgaaaaaacacattttcccgagagtgacatttgggacattctct

SEQ ID NO: 196 - DNA, 4436 bp, Artificial Sequence
  linear fragment, Ll_ilvD_coSc &G418
caccagtaaaacatacgcatacacatacacacatagagcaagcaagcaggctagcaaccaggaaaggctgccagtgactgctactgggtgtctaagaaccgtagggcggattattgttgcggtggttggttgcgggtggttatgcgatggtacggtgcagaatcgtacggtgttggttatggaattagtatgggtatgtgatatgtggtaatatgtgatattgggttattgtgatttggaatactgaatatcgaatatgggatatggaatatggccatggcatggtatggtatgggatgggagtattctattttattttattttattctggttcctgcgtttagggtagggtaggaagaaggtgagtgcttttgtatataagtggagtgtctggatcagttttgtggattgtgaatgttgttagtttcccctttaatgtatatttgtattatttgcttttgagtactcaataaccaagcacaactactagttttaaaggatccatcctcttaaacagtacaatcgcaaagaaaagctccacacccaaaccaaataattgcaatggagtttaagtataacggcaaagttgaatctgttgaactgaataagtacagcaaaacgttgacacaagatcccacacaacccgccacacaggcaatgtattacggcatcgggtttaaagacgaagatttcaagaaagctcaagtgggtatagtgtcgatggactgggatggaaatccatgcaacatgcatttaggaacccttggatcaaagattaaaagctcagtaaatcagacagatggtctgatcggcttacaatttcatacgataggagtttctgatgggatagcaaatggaaagttgggaatgagatactcccttgtttccagagaagttatagctgactctattgaaaccaacgctggcgctgaatactatgatgcaattgtagccatcccaggttgtgacaaaaatatgccaggttctattattggtatggcaagacttaataggccaagcattatggtgtatggaggaacaatagaacacggtgaatataaaggtgagaaattgaacatcgtatcggcttttgaatctctaggccagaaaattaccggcaatatctctgatgaagattatcacggtgttatttgtaatgctattcctggtcaaggggcatgtggggggatgtacacagctaataccttagctgccgctatcgaaacactaggtatgtcattgccgtattcttcttcgaaccctgcagtatctcaagaaaaacaagaagaatgtgatgagattggattagccattaagaatcttttggaaaaagacatcaagcctagtgatataatgactaaggaggcgttcgagaacgctattaccattgtgatggtcttggggggtagtactaatgctgtcttgcatattattgcaatggctaacgcgataggtgtcgaaataactcaggatgacttccaaagaattagtgacattactccagtactaggtgattttaaaccttcaggtaaatatatgatggaagatttgcataaaattggaggcttgccagcagtgcttaagtaccttctaaaggaaggaaaattgcatggtgactgccttactgtgacgggtaaaacattagccgagaatgtcgagactgccctagacttggatttcgactcacaagatatcatgaggccactaaagaatcctatcaaggccaccggccacttgcagattctgtacggtaatttagctcaagggggttccgtagcaaaaattagcggtaaagaaggagagttcttcaaaggcactgccagagtctttgatggtgaacaacattttatcgacggcatagaatctggtcgtttgcatgctggagatgtagcggtaattaggaatataggtcccgtcggcggacctggtatgcccgaaatgctgaagcctacatcagcattaattggtgcgggtttagggaaaagttgcgcgttaattacggatggtagattctccggtggcactcacggttttgttgtcggccatattgtgcctgaagccgttgagggtggactaatcggcttagttgaagatgacgatataatagagatagatgcagtcaacaactctatatccctgaaagtttccgatgaagaaatcgcaaagagaagagctaattatcagaagccaactccgaaagccaccaggggagttttggcaaaattcgctaaattaacccgtcctgcatcggaagggtgtgttactgatctgtaatgtttaaagattacggatatttaacttacttagaataatgccatttttttgagttataataatcctacgttagtgtgagcgggatttaaactgtgaggaccttaatacattcagacacttctgcggtatcaccctacttattcccttcgagattatatctaggaacccatcaggttggtggaagattacccgttctaagacttttcagcttcctctattgatgttacacctggacaccccttttctggcatccagtttttaatcttcagtggcatgtgagattctccgaaattaattaaagcaatcacacaattctctcggataccacctcggttgaaactgacaggtggtttgttacgcatgctaatgcaaaggagcctatatacctttggctcggctgctgtaacagggaatataaagggcagcataatttaggagtttagtgaacttgcaacatttactattttcccttcttacgtaaatatttttctttttaattctaaatcaatctttttcaattttttgtttgtattcttttcttgcttaaatctataactacaaaaaacacatacataaactaaaaactagtatgggtaaggaaaagactcacgtttcgaggccgcgattaaattccaacatggatgctgatttatatgggtataaatgggctcgcgataatgtcgggcaatcaggtgcgacaatctatcgattgtatgggaagcccgatgcgccagagttgtttctgaaacatggcaaaggtagcgttgccaatgatgttgcagatgagatggtcagactaaactggctgacggaatttatgcctcttccgaccatcaagcattttgtccgtactcctgatgatgcatggttactcaccactgcgatccccggcaaaacagcattccaggtattagaagaatatcctgattcaggtgaaaatattgttgatgcgctggcagtgttcctgcgccggttgcattcgattcctgtttgtaattgtccttttaacagcgatcgcgtatttcgcctcgctcaggcgcaatcacgaatgaataacggtttggttgacgcgagtgattttgatgacgagcgtaatggctggcctgttgaacaagtctggaaagaaatgcataagcttttgccattctcaccggattcagtcgtcactcatggtgatttctcacttgataaccttatttttgacgaggggaaattaataggttgtattgatgttggacgagtcgggatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaactcaactcaagacgcacagatattataacatctgcataataggcatttgcaagaattactcgtgagtaaggaaagagtgaggaactatcgcatacctgcatttaaagatgccgatttgggcgcgaatcctttattttggcttcaccctcatactattatcagggccagaaaaaggaagtgtttccctccttcttgaattgatgttaccctcataaagcacgtggcctcttatcgagaaagaaattaccgtcgctcgtgatttgtttgcaaaaagaacaaaactgaaaaaacccagacacgctcgacttcctgtcttcctattgattgcagcttccaatttcgtcacacaacaaggtcctagcgacggctcacaggttttgtaacaagcaatcgaaggttctggaatggcgggaaagggtttagtaccacatgctatgatgcccactgtgatctccagagcaaagttcgttcgatcgtactgttactctctctctttcaaacagaattgtccgaatcgtgtgacaacaacagcctgttctcacacactcttttcttctaaccaagggggtggtttagtttagtagaacctcgtgaaacttacatttacatatatataaacttgcataaattggtcaatgcaagaaatacatatttggtcttttctaattcgtagtttttcaagttcttagatgctttctttttctcttttttacagatcatcaaggaagtaattatctactttttacaacaaatataaaacaag

SEQ ID NO: 197 - DNA, 24 bp, Artificial Sequence
  Primer pGK1F
aatgcaagaaatacatatttggtc

SEQ ID NO: 198 - DNA, 20 bp, Artificial Sequence
  Primer KmAFTR
gaaacctcgctgttgctact

SEQ ID NO: 199 - DNA, 21 bp, Artificial Sequence
  Primer oGV2107
cgttgacacaagatcccacac

SEQ ID NO: 200 - DNA, 22 bp, Artificial Sequence
  Primer oGV2108
ccatcgacactatacccacttg

SEQ ID NO: 201 - DNA, 5036 bp, Artificial Sequence
  linear fragment, KL_AFT & G418
cccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccataccacagcttttcaattcaattcatcattttttttttattcttttttttgatttcggtttctttgaaatttttttgattcggtaatctccgaacagaaggaagaacgaaggaaggagcacagacttagattggtatatatacgcatatggcaaattaaagccttcgagcgtcccaaaaccttctcaagcaaggttttcagtataatgttacatgcgtacacgcgtctgtacagaaaaaaaagaaaaatttgaaatataaataacgttcttaatactaacataactataaaaaaataaatagggacctagacttcaggttgtctaactccttccttttcggttagagcggatgtggggggagggcgtgaatgtaagcgtgacataactaattacatgactcgacctaggtcattgaaaaaagccgtgaggttcatcccaaagcatttgtggattatgcgtagcttgctgcggttggtcaagatcattattaaactgtaggtgataattgtactccgaattcgcaacgagctcttcaatctcttcctctttcaaaggtaaaatctcatgtagagggttgtgctgatcatgaagttgttgctgttgctgttgctgttgcatttgctgttgctgttgattttgcatctgatgctggtggcggcgttgctgctgcatatgttgttgatggtgttgctctccttgattatgttgactttgtgataatcgcagttcgttgaagtcagagtttaatacattagaaatgtattcctgtgattgagcatcataatctggctttgtatgcagaggatccatgtagcccgtcgcatcgtttgattggctgataccattagcgatctccatgtttgaacgatctatattgagtccatgaataccagtagcagtaccaatgagaggaccaccacattgagggtcattagcacatacgtcaaagttgttaatttcgcatactgcactaatgttctgatttactggcgatagattggaatgttggaaatttagtgaatgcgaaggtatcatggcattagcatgactagtattatgttgttgatgaagatggttattattagtattaacggatgaagtattagcattagaatggtcattattattggttgaagtaccaaatatttggttcatgtcaatgaaatcttgtataggctccttggccaagttggacgaataaagtggcacagaactgatcgcgttcatattgtgagagtttgtactgggagtagccgttgtaatgggagtctttacagacgtcattatactcatatttggggacgaatgcgtagaagatgcagaaccagcattatggtacattagattactgttgatgttttggtgaggggtatgttgagcactttgagaactcgtttggtgtttctgggaaaatgtaagtggaatcatgccttggcctgtaaccacatcatgtcgattatttttgaagtgaggcaaaggtttactgaagaactccgtgaagtcaatttcattttgcacgttgaaatagttcgagttgaagtttgagaagttaggtgaatccatctgttgcgaagaagcagtattcggcaagaaatcagttgagtaaatattctcttgaggcgttagggccaagtttgaattcaggttagaagtcacagatggagctactgaaacatttgattgggaatcgaactgtaaattcaacgaattctgcacagtacttagcggagttgctgttctcgaagtgtttgcactattgctctctatatcttgttgtaactttttctttgtgcttttacgtctcagctgttttgtagtcttactcttgacagcttttttaccggtcttctttggttttgttactgtattggcatccatggaagtattccttgacccaggtacgatgatatttgttgtaggcaaaacgatattgaaggattgaatttcctgagtaagaccacaatcacaggggatgggactaagatcaatgggcaagttaaaccttgttctgtactccaattcatcgaactttttaacggtttcaaggtctccgctttcctttagagcattcttaaactttttataatcttcactatcggggttaaacttcaacggatgggtgtgtacgttattgacaacgacgatgttccacttctttctcttcaaagagaacgtggctcgcactctgaagggacatgaattgtacggtccgatggcacgtttcttcttgtctgtatcgttactaccatttccaccaccgacagtactgttactattattaccgttttctgtctctgtttcaagaccatcacattcggcaaaacccttcccgattccctttttcctacacttattatcattactaccattacccttagtactgttcttcccattagtgttacaactatcgctaccaacgccgtggctgtgaccacacccggatatagacgaagtatttctattctttttaacagctttacatttgaacacgatcttcatgctatccgaccgttcaatgacgatctcaatcccctgtggataaaaaatcttctgtaaccacggtttaacttcactcttatctttgaagtcagggatcggatccaaatgaatcaatttattctggtcttgctgtctccgaagagcttctatcgcgttttcactcaacgcattgttataagagacttcgctattattactcgaggataaattcgagccaacatggtgagccgccggtgtatgggacagtccagaaccgatgggcgaagtcttcggcgaagccatcatattgtcaaaagatggagaaggctgccataaatccggattatgaagaggatccaagggatccactccttcaataggtgtctgtagctcgtgcttcatggtacctattattgtatgttatagtattagttgcttggtgttatgaaagaaactaagaaaagaaaaataaaataaaaataaaagattgagacaagggaagaaaagatacaaaataagaattaattacaattgcgtttgctataaatacgtttttaacaatcaactctggtaggaagataatgctttttttttttatatatgcttggtgccacttgtcacatacaattctacaaccttcgacaaaaatccaaatgatagtaagatcaaagccagaaagcaatggagaaaaaaaattaatgaaccacgatgaaccaaatgatcaatacaaccaaagaaactaccctagtgaggtgtatgctgacttggtatcacacttcatgaattttgcatatggcaaagtccacgaaagtgggcttcagaaaaaaggcgtgcggtgtgtagatgtatcaattagtggatgccagttttggaacgggattccactttccgcaagttggtgcacgtcgttagtgacataacgccgcgttcatctttgggaagaagcagatgctgagcgaggaggtactatagagtaaagaaccctttctatacccgcagccccatgaattcttagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgatcccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcgtcaaccaaaccgttattcattcgtgattgcgcctgagcgaggcgaaatacgcgatcgctgttaaaaggacaattacaaacaggaatcgaatgcaaccggcgcaggaacactgccagcgcatcaacaatattttcacctgaatcaggatattcttctaatacctggaatgctgttttgccggggatcgcagtggtgagtaaccatgcatcatcaggagtacggacaaaatgcttgatggtcggaagaggcataaattccgtcagccagtttagtctgaccatctcatctgcaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgaaacgtgagtcttttccttacccatactagtttttagtttatgtatgtgttttttgtagttatagatttaagcaagaaaagaatacaaacaaaaaattgaaaaagattgatttagaattaaaaagaaaaatatttacgtaagaagggaaaatagtaaatgttgcaagttcactaaactcctaaattatgctgccctttatattccctgttacagcagccgagccaaaggtatataggctcctttgcattagcatgcgtaacaaaccacctgtcagtttcaaccgaggtggtatccgagagaattgtgtgattgctttaattaatttcggagaatctcacatgccactgaagattaaaaactggatgccagaaaaggggtgtccaggtgtaacatcaatagaggaagctgaaaagtcttagaacgggtaatcttccaccaacctgatgggttcctagatataatctcgaagggaataagtagggtgataccgcagaagtgtctgaatgtattaaggtcctcacagtttaaatcccgctcacactaacgtaggattattataactcaaaaaaatggcattattctaagtaagttaaatatccgtaatctttaaacagcggccgca

SEQ ID NO: 202 - DNA, 1950 bp, Saccharomyces cerevisiae
atgccagtggaggagcctcttgctacactttcatcaattccagattctagcgcggaccaggccccaccgttaatagcagatgaatttacgttagacctgcccagaattccaagtttagaattgccacttaatgtctccacaaaacactctagtatacagaaggctataaaaatgtgtgggggcatcgaaaaagtgaaagaagcctttaaagaacatggacctatcgaatctcagcacggattacaactgtacttaaacgatgatactgatagcgacggatccaagagctattttaatgagcatcctgtaattggtaaaagagttcccttcagagatgagtcggtcatattaaaggttacaatgcctaagggaactttaagtaaaaataataatagcgtcaaagattctatcaaatccttaaaagattcgaataaattgagagtcactcctgtttccatagtagataacactataaaatttagagaaatgtcagattttcaaatcaaactggataatgtcccctctgcaagagagttcaaaagtagctttggctctctggaatggaataatttcaaaagttttgtcaattctgtaccagataatgactctcaacctcaggaaaacatcgggaatttgatcttagaccgtagcgttaaaattccgagtacagatttccaactgccgccacctcctaagttatcaatggttggtttccccctgctttataaatataaagctaatccatttgcgaaaaaaaaaaaaaacggtgtcacagaagtgaagggaacatatatcaaaaactatcagttgtttgttcatgatcttagtgataagacagttataccgtcccaagctcatgaacaagtcctgtacgattttgaggtcgcgaagaaaacaaaagtctatccaggcactaaaagtgactctaaattttatgaatcgctggaggaatgcttgaaaattttgagagagctcttcgctagacgtccaatttgggttaaaagacatcttgatgggattgtcccgaagaagatacaccatactatgaagatagcgctggcactcatatcttatcgtttcacaatggggccttggagaaatacatatatcaaatttggtatagaccccagaagttcagtggaatacgcccaatatcaaacagaatattttaagattgaaaggaaattactatcttctcccatagtgaaaaagaatgtaccaaagccaccacccctggtattcgaatcagacactccaggcggtattgacagcaggttcaaatttgatggaaaaagaataccgtggtacctgatgttgcagattgatttattaattggtgagccaaacattgcagaagtttttcacaacgtcgaatatttagataaggcgaatgaactaactggatggttcaaagaattagacttggtcaagataagaaggatagtaaaatacgaacttggttgcatggttcaaggaaattatgagtataataaatacaagttgaagtatttcaagacaatgttatttgttaaagaatccatggtacccgaaaacaagaactcagaagagggaatgggtgttaacaccaataaagatgctgatggggacataaatatggatgcaggtagtcaaatgtcctcaaatgccatagaggaggataagggtatcgctgctggtgatgattttgatgataatggcgccataactgaagagccagacgacgctgctttggaaaatgaagagatggacactgatcagaacttgaaggtgcctgcaagtatagacgatgacgtggatgacgttgatgcagatgaagaagaacaagaaagttttgatgttaaaacagcgagcttccaagatatcataaataaaatagctaaactagatcctaaaaccgcggaaacaatgaaaagcgagctcaagggatttgttgatgaagtcgatctgtaa

SEQ ID NO: 203 - protein, 649 aa, Saccharomyces cerevisiae
MPVEEPLATLSSIPDSSADQAPPLIADEFTLDLPRIPSLELPLNVSTKHSSIQKAIKMCGGIEKVKEAFKEHGPIESQHGLQLYLNDDTDSDGSKSYFNEHPVIGKRVPFRDESVILKVTMPKGTLSKNNNSVKDSIKSLKDSNKLRVTPVSIVDNTIKFREMSDFQIKLDNVPSAREFKSSFGSLEWNNFKSFVNSVPDNDSQPQENIGNLILDRSVKIPSTDFQLPPPPKLSMVGFPLLYKYKANPFAKKKKNGVTEVKGTYIKNYQLFVHDLSDKTVIPSQAHEQVLYDFEVAKKTKVYPGTKSDSKFYESLEECLKILRELFARRPIWVKRHLDGIVPKKIHHTMKIALALISYRFTMGPWRNTYIKFGIDPRSSVEYAQYQTEYFKIERKLLSSPIVKKNVPKPPPLVFESDTPGGIDSRFKFDGKRIPWYLMLQIDLLIGEPNIAEVFHNVEYLDKANELTGWFKELDLVKIRRIVKYELGCMVQGNYEYNKYKLKYFKTMLFVKESMVPENKNSEEGMGVNTNKDADGDINMDAGSQMSSNAIEEDKGIAAGDDFDDNGAITEEPDDAALENEEMDTDQNLKVPASIDDDVDDVDADEEEQESFDVKTASFQDIINKIAKLDPKTAETMKSELKGFVDEVDL

SEQ ID NO: 204 - DNA, 1713 bp, Lactococcus lactis
atggaattcaaatacaatggtaaagttgaatccgttgaacttaacaaatactccaagactttaacccaagatccaactcaaccagccactcaggccatgtattacggtattggtttcaaagacgaagatttcaaaaaggctcaagttggtattgtgtcaatggactgggatggtaatccatgtaacatgcacttgggtactttaggttccaagattaagtcctccgttaaccagaccgacggtctaataggtttgcaatttcataccattggtgtttccgacggtattgcaaatggcaaattgggtatgagatattctcttgtttcaagagaagttatcgctgattcaatcgaaacaaatgctggtgcagaatactatgatgcaatcgttgcaattcctggttgtgacaaaaacatgccaggttccattatcggtatggctagattgaatagaccatccattatggtttatggtggtacgattgaacacggagagtataagggtgagaagttaaacattgtttctgctttcgaatcactcggtcaaaagattacaggcaacatttctgatgaagattatcacggcgttatctgtaacgctatccctggacaaggtgcttgtggtggcatgtacactgcaaacactttagcagcagctatcgaaactctaggtatgtctttaccatattcctcctctaacccagcagtttctcaagagaaacaggaagagtgtgacgaaattggtttggcgatcaaaaacttgttagaaaaagatatcaaaccatctgacattatgaccaaagaggctttcgaaaatgccataactattgttatggttttgggtggttcaaccaatgctgttttacacattatcgcaatggcaaacgctattggagttgaaatcacacaagatgatttccaaaggattagtgatatcactccagttttaggcgatttcaaaccaagtggaaagtacatgatggaagatttgcacaagattggtggtctaccagctgttttgaagtatctccttaaggaaggcaaattgcatggtgactgcttaaccgttaccggaaaaaccttagcagagaatgttgaaacggcattagatttggactttgattctcaagatatcatgcgtcctttgaaaaacccaatcaaggctactggtcatctccaaatcttatacggtaatctagctcaaggtggatccgttgctaagattagtggtaaagagggcgagtttttcaagggtacagccagggtttttgatggtgaacaacactttatcgatggtatcgaatctggtagattgcatgcaggcgatgttgctgttatcagaaacattggtccagttggtggcccaggcatgcctgaaatgttaaagccaacttctgctttgattggtgccggtttaggaaaatcatgcgctcttatcaccgatggtagattttctggcggtacacatggttttgttgttggtcatattgttccagaagcagttgaaggtggtcttatcggtttagtggaagatgacgacattatcgaaattgatgcagtgaataactctatttccttgaaagtttccgatgaagagattgctaaacgtagagcaaactaccaaaaacctactccaaaagcgaccagaggtgttttagcaaagttcgccaaattgaccagaccagcgtctgaaggttgtgttactgacttgtaa

SEQ ID NO: 205 - protein, 570 aa, Lactococcus lactis; identical to SEQ ID NO: 49

SEQ ID NO: 206 - DNA, 1713 bp, Lactococcus lactis
atggagtttaagtacaacggcaaagtcgaatctgttgaattgaacaaatactctaagactctaactcaagatccaactcaaccagctactcaagcaatgtattatggtattggcttcaaggatgaggatttcaaaaaggcacaagtcggtattgtaagcatggattgggatggaaatccatgtaacatgcatctaggaacacttggtagcaagataaagtccagtgtgaaccaaactgatggtctaattggactacaattccataccatcggtgtttccgatggaattgcaaacggtaagcttggcatgagatactctttagtgagcagagaagttattgcagattccattgagacaaatgctggtgctgaatactacgacgcaatcgtggcaattccaggatgcgacaaaaacatgcctggttcaattatcggtatggcacgtttgaacagaccatcaattatggtttacggaggtacaatagaacatggtgaatacaaaggtgaaaagttgaacattgtttctgcatttgagtctttgggccaaaagattacaggtaacatttctgatgaagattatcatggagtcatatgcaatgcaattcctggccaaggtgcttgtggtggaatgtacacagctaacacattagctgctgcaatcgaaacattaggcatgtcattgccttacagctcttccaacccagctgtatcccaggaaaaacaggaagagtgtgatgaaatcggtttagcaatcaaaaacttattagaaaaggacattaagccttccgacataatgactaaggaagcttttgaaaatgctatcacaatagtgatggtccttggtggctctaccaacgcagttttacacatcattgcaatggcaaatgcaataggagttgaaatcacacaagatgattttcaacgtatctccgatatcacacctgtcctaggcgatttcaaaccatctggcaagtatatgatggaggatctacacaagattggaggacttcctgcagtcttaaagtatttgttgaaagagggtaaattgcatggtgattgtttaaccgtcactggcaagaccttggcagaaaatgtagaaactgctttggatttggatttcgatagtcaagatatcatgaggccattgaaaaaccctatcaaggctactggtcacttacaaatcttatacggcaatctagcacaaggtggttctgtcgctaagattagtggtaaggaaggagagtttttcaagggtacagcaagagtttttgatggtgaacaacactttatcgatggcatagaaagtggtagattgcatgcaggcgatgtggctgtaattagaaacattggaccagttggcggacctggtatgcctgaaatgctaaagcctacttccgcactaattggagctggtcttggtaaatcatgtgctttaatcaccgatggtagattctccggtggcacacatggttttgtagttggccatatcgtaccagaagctgttgaaggaggtcttataggcttagtagaagatgatgacataatcgaaatagacgcagtgaacaatagcatctcactaaaagtttctgatgaggaaatagcaaagagaagggctaattaccagaagccaactccaaaggcaaccagaggtgttctagctaagtttgctaagttaactagacctgctagcgaaggatgtgttacagacttatga

SEQ ID NO: 207 - protein, 570 aa, Lactococcus lactis; identical to SEQ ID NO: 49

SEQ ID NO: 208 - DNA, 2073 bp, Saccharomyces cerevisiae; identical to SEQ ID NO: 1

SEQ ID NO: 209 - protein, 690 aa, Saccharomyces cerevisiae; identical to SEQ ID NO: 2

SEQ ID NO: 210 - DNA, 2073 bp, Saccharomyces cerevisiae
atggaaggcttcaatccggctcacatagaacatgcgtcaccgattaattcatctgacagccattcatcctcctttgtatatgctctacccaaaagtgctagtgaatatgtagtcaaccataatgagggtcgtgcaagtgcaagtggaaatccagccgcagtgccgtctcccataatgacactgaatctcaaaagcacacattccctcaatagtgatcagcatgttcatacctcaacatcgccgacggaaactattgggcatattcatcatgtggaaaagctgaatcaaaacaatttgattcatctggatccagtacccaactttgaagataagtccgatattaagccttggttgcaaaagattttttatcctcaaggaatagaacttgtgatagaaaggtcggacacatttaaagttgtcttcaagtgtaaagctgctaaaaggggaaggaacgcgagaaggaaaagaaaagataagcccaaaggacaggaccacgaagacgagaaatccaagatcaatgatgacgaattagaatatgcgagtccttctaatgccacagtaaccaatgggcctcaaacatcgcccgatcaaacatcctccataaagccaaagaaaaaaagatgtgtatcgaggtttaataactgtccgtttagagtacgagctacttattcgttaaagaggaaaagatggagcattgttgtaatgaacaataaccattcacatcagctaaagtttaaccctgattccgaagagtacaaaaaattcaaagaaaaattaagaaaggataatgacgtagatgcaatcaagaaattcgacgaattggaatacagaactttggccaatttgcccattccaacagctacaatcccctgtgattgtggtttaacaaatgaaatacaaagtttcaatgtcgtattgcccactaacagtaatgttacttcatcagcatcctcttcaactgtatcgtccatatcccttgattcatcgaatgcatctaaaaggccatgcttaccctctgtaaataacaccggtagtatcaataccaataacgtaaggaaaccgaaaagccagtgtaagaataaagacacactcttaaaaagaaccaccatgcagaactttctcacaactaaatcaaggctgcgtaagaccggtacgccaacatcttcgcaacactcatctacagcattttcaggatatattgatgatcctttcaatttgaatgaaatcttgccactgccggcatccgatttcaagctaaacactgtaacaaatttgaacgaaattgactttacgaacatttttaccaaatcgccgcatccacatagcgggtctacccatccaagacaagtcttcgaccaattggacgattgttcctctatactcttctctccattaactacaaacacgaataatgaatttgaaggagagtcagatgattttgttcattctccatatttgaactcagaggcagatttcagccaaattcttagtagtgctcccccagtccatcatgacccaaatgaaacacatcaggaaaaccaggatattattgatagatttgctaatagttcccaagaacataatgagtatattctacaatatttgacgcacttcgatgctgctaaccacaataacatcggcgttccaaacaacaattcacattcgctaaatactcagcataacgtttctgatctgggcaacccacttttaagacaagaagctttagttggcagctcttcaacaaaaatcttcgacgaattgaaatttgtacaaaatggcccacacggttctcaacatcctatagattttcaacatgttgaccatcgtcatctcagctctaatgaacctcaagtacgatcacatcaatatggtccgcaacagcagccaccgcagcaattgcaatatcaccaaaatcagccccacgacggccataaccacgaacagcaccaaacagtacaaaaggatatgcaaacgcatgaatcgctagaaataatgggaaacacattattggaagagttcaaagacattaaaatggtgaacggcgagttgaagtatgtgaagccagaagattag

SEQ ID NO: 211 - protein, 690 aa, Saccharomyces cerevisiae
MEGFNPAHIEHASPINSSDSHSSSFVYALPKSASEYVVNHNEGRASASGNPAAVPSPIMTLNLKSTHSLNSDQHVHTSTSPTETIGHIHHVEKLNQNNLIHLDPVPNFEDKSDIKPWLQKIFYPQGIELVIERSDTFKVVFKCKAAKRGRNARRKRKDKPKGQDHEDEKSKINDDELEYASPSNATVTNGPQTSPDQTSSIKPKKKRCVSRFNNCPFRVRATYSLKRKRWSIVVMNNNHSHQLKFNPDSEEYKKFKEKLRKDNDVDAIKKFDELEYRTLANLPIPTATIPCDCGLTNEIQSFNVVLPTNSNVTSSASSSTVSSISLDSSNASKRPCLPSVNNTGSINTNNVRKPKSQCKNKDTLLKRTTMQNFLTTKSRLRKTGTPTSSQHSSTAFSGYIDDPFNLNEILPLPASDFKLNTVTNLNEIDFTNIFTKSPHPHSGSTHPRQVFDQLDDCSSILFSPLTTNTNNEFEGESDDFVHSPYLNSEADFSQILSSAPPVHHDPNETHQENQDIIDRFANSSQEHNEYILQYLTHFDAANHNNIGVPNNNSHSLNTQHNVSDLGNPLLRQEALVGSSSTKIFDELKFVQNGPHGSQHPIDFQHVDHRHLSSNEPQVRSHQYGPQQQPPQQLQYHQNQPHDGHNHEQHQTVQKDMQTHESLEIMGNTLLEEFKDIKMVNGELKYVKPED

SEQ ID NO: 212 - DNA, 2073 bp, Saccharomyces cerevisiae; identical to SEQ ID NO: 210

SEQ ID NO: 213 - protein, 690 aa, Saccharomyces cerevisiae; identical to SEQ ID NO: 211

SEQ ID NO: 214 - DNA, 2073 bp, Saccharomyces cerevisiae; identical to SEQ ID NO: 210

SEQ ID NO: 215 - protein, 690 aa, Saccharomyces cerevisiae; identical to SEQ ID NO: 211

SEQ ID NO: 216 - DNA, 2073 bp, Saccharomyces cerevisiae; identical to SEQ ID NO: 210

SEQ ID NO: 217 - protein, 690 aa, Saccharomyces cerevisiae; identical to SEQ ID NO: 211

SEQ ID NO: 218 - DNA, 2073 bp, Saccharomyces cerevisiae
atggaaggcttcaatccggctcacatagaacatgcgtcaccgattaattcatctgacagccattcatcctcctttgtatatggtctacccaaaagtgctagtgaatatgtagtcaaccataatgagggtcgtgcaagtgcaagtggaaatccagccgcagtgccgtctcccataatgacactgaatctcaaaagcacacattccctcaatagtgatcagcatgttcatacctcaacatcgccgacggaaactattgggcatattcatcatgtggaaaagctgaatcaaaacaatttgattcatctggatccagtacccaactttgaagataagtccgatattaagccttggttgcaaaagattttttatcctcaaggaatagaacttgtgatagaaaggtcggacacatttaaagttgtcttcaagtgtaaagctgctaaaaggggaaggaacgcgagaaggaaaagaaaagataagcccaaaggacaggaccacgaagacgagaaatccaagatcaatgatgacgaattagaatatgcgagtccttctaatgccacagtaaccaatgggcctcaaacatcgcccgatcaaacatcctccataaagccaaagaaaaaaagatgtgtatcgaggtttaataactgtccgtttagagtacgagctacttattcgttaaagaggaaaagatggagcattgttgtaatgaacaataaccattcacatcagctaaagtttaaccctgattccgaagagtacaaaaaattcaaagaaaaattaagaaaggataatgacgtagatgcaatcaagaaattcgacgaattggaatacagaactttggccaatttgcccattccaacagctacaatcccctgtgattgtggtttaacaaatgaaatacaaagtttcaatgtcgtattgcccactaacagtaatgttacttcatcagcatcctcttcaactgtatcgtccatatcccttgattcatcgaatgcatctaaaaggccatgcttaccctctgtaaataacaccggtagtatcaataccaataacgtaaggaaaccgaaaagccagtgtaagaataaagacacactcttaaaaagaaccaccatgcagaactttctcacaactaaatcaaggctgcgtaagaccggtacgccaacatcttcgcaacactcatctacagcattttcaggatatattgatgatcctttcaatttgaatgaaatcttgccactgccggcatccgatttcaagctaaacactgtaacaaatttgaacgaaattgactttacgaacatttttaccaaatcgccgcatccacatagcgggtctacccatccaagacaagtcttcgaccaattggacgattgttcctctatactcttctctccattaactacaaacacgaataatgaatttgaaggagagtcagatgattttgttcattctccatatttgaactcagaggcagatttcagccaaattcttagtagtgctcccccagtccatcatgacccaaatgaaacacatcaggaaaacctggatattattgatagatttgctaatagttcccaagaacataatgagtatattctacaatatttgacgcacttcgatgctgctaaccacaataacatcggcgttccaaacaacaattcacattcgctaaatactcagcataacgtttctgatctgggcaacccacttttaagacaagaagctttagttggcagctcttcaacaaaaatcttcgacgaattgaaatttgtacaaaatggcccacacggttctcaacatcctatagattttcaacatgttgaccatcgtcatctcagctctaatgaacctcaagtacgatcacatcaatatggtccgcaacagcagccaccgcagcaattgcaatatcaccaaaatcagccccacgacggccataaccacgaacagcaccaaacagtacaaaaggatatgcaaacgcatgaatcgctagaaataatgggaaacacattattggaagagttcaaagacattaaaatggtgaacggcgagttgaagtatgtgaagccagaagattag

SEQ ID NO: 219 - protein, 690 aa, Saccharomyces cerevisiae
MEGFNPAHIEHASPINSSDSHSSSFVYGLPKSASEYVVNHNEGRASASGNPAAVPSPIMTLNLKSTHSLNSDQHVHTSTSPTETIGHIHHVEKLNQNNLIHLDPVPNFEDKSDIKPWLQKIFYPQGIELVIERSDTFKVVFKCKAAKRGRNARRKRKDKPKGQDHEDEKSKINDDELEYASPSNATVTNGPQTSPDQTSSIKPKKKRCVSRFNNCPFRVRATYSLKRKRWSIVVMNNNHSHQLKFNPDSEEYKKFKEKLRKDNDVDAIKKFDELEYRTLANLPIPTATIPCDCGLTNEIQSFNVVLPTNSNVTSSASSSTVSSISLDSSNASKRPCLPSVNNTGSINTNNVRKPKSQCKNKDTLLKRTTMQNFLTTKSRLRKTGTPTSSQHSSTAFSGYIDDPFNLNEILPLPASDFKLNTVTNLNEIDFTNIFTKSPHPHSGSTHPRQVFDQLDDCSSILFSPLTTNTNNEFEGESDDFVHSPYLNSEADFSQILSSAPPVHHDPNETHQENLDIIDRFANSSQEHNEYILQYLTHFDAANHNNIGVPNNNSHSLNTQHNVSDLGNPLLRQEALVGSSSTKIFDELKFVQNGPHGSQHPIDFQHVDHRHLSSNEPQVRSHQYGPQQQPPQQLQYHQNQPHDGHNHEQHQTVQKDMQTHESLEIMGNTLLEEFKDIKMVNGELKYVKPED

SEQ ID NO: 220 - DNA, 2073 bp, Saccharomyces cerevisiae
atggaaggcttcaatccggctcacatagaacatgcgtcaccgattaattcatctgacagccattcatcctcctttgtatatgctctacccaaaagtgctagtgaatatgtagtcaaccataatgagggtcgtgcaagtgcaagtggaaatccagccgcagtgccgtctcccataatgacactgaatctcaaaagcacacattccctcaatagtgatcagcatgttcatacctcaacatcgccgacggaaactattgggcatattcatcatgtggaaaagctgaatcaaaacaatttgattcatctggatccagtacccaactttgaagataagtccgatattaagccttggttgcaaaagattttttatcctcaaggaatagaacttgtgatagaaaggtcggacacatttaaagttgtcttcaagtgtaaagctgctaaaaggggaaggaacgcgagaaggaaaagaaaagataagcccaaaggacaggaacacgaagacgagaaatccaagatcaatgatgacgaattagaatatgcgagtccttctaatgccacagtaaccaatgggcctcaaacatcgcccgatcaaacatcctccataaagccaaagaaaaaaagatgtgtatcgaggtttaataactgtccgtttagagtacgagctacttattcgttaaagaggaaaagatggagcattgttgtaatgaacaataaccattcacatcagctaaagtttaaccctgattccgaagagtacaaaaaattcaaagaaaaattaagaaaggataatgacgtagatgcaatcaagaaattcgacgaattggaatacagaactttggccaatttgcccattccaacagctacaatcccatgtgattgtggtttaacaaatgaaatacaaagtttcaatgtcgtcttgcccactaacagtaatgttacttcatcagcatcctcttcaactgtatcgtccatatcccttgattcatcgaatgcatctaaaaggccatgcttaccctctgtaaataacaccggtagtatcaataccaataacgtaaggaaaccgaaaagccagtgtaagaataaagacacactcttaaaaagaaccaccatgcagaactttctcacaactaaatcaaggctgcgtaagaccggtacgccaacatcttcgcaacactcatctacagcattttcaggatatattgatgatcctttcaatttgaatgaaatcttgccactgccggcatccgatttcaagctaaacactgtaacaaatttgaacgaaattgactttacgaacatttttaccaaatcgccgcatccacatagcgggtctacccatccaagacaagtcttcgaccaattggacgattgttcctctatactcttctctccattaactacaaacacgaataatgaatttgaaggagagtcagatgattttgttcattctccatatttgaactcagaggcagatttcagccaaattcttagtagtgctcccccagtccatcatgacccaagtgaaacacatcaggaaaaccaggatattattgatagatttgctaatagctcccaagaacataatgagtatattctacaatatttgacgcacttcgatgctgctaaccacaataatatcggcgttccaaacaacaattcacattcgctaaatactcagcataacgtttctgatctgggcaacccacttttaagacaagaagctttagttggcagctcttcaacaaaaatcttcgatgaattgaaatttgtacaaaatggcccacacggttctcaacatcctatagattttcaacatgttgaccatcgtcatctcagctctaatgaacctcaagtacgatcacatcaatatggtccgcaacagcagccaccgcagcaattgcaatatcaccaaaatcagccccacgacgggcataaccacgaacagcttcaaacagtacaaaaggatatgcaaacgcatgaatcgctagaaataatgggaaacacattattggaagagttcaaagacattaaaatggtgaacggcgagttgaagtatgtgaagccagaagattag

SEQ ID NO: 221 - protein, 690 aa, Saccharomyces cerevisiae
MEGFNPAHIEHASPINSSDSHSSSFVYALPKSASEYVVNHNEGRASASGNPAAVPSPIMTLNLKSTHSLNSDQHVHTSTSPTETIGHIHHVEKLNQNNLIHLDPVPNFEDKSDIKPWLQKIFYPQGIELVIERSDTFKVVFKCKAAKRGRNARRKRKDKPKGQEHEDEKSKINDDELEYASPSNATVTNGPQTSPDQTSSIKPKKKRCVSRFNNCPFRVRATYSLKRKRWSIVVMNNNHSHQLKFNPDSEEYKKFKEKLRKDNDVDAIKKFDELEYRTLANLPIPTATIPCDCGLTNEIQSFNVVLPTNSNVTSSASSSTVSSISLDSSNASKRPCLPSVNNTGSINTNNVRKPKSQCKNKDTLLKRTTMQNFLTTKSRLRKTGTPTSSQHSSTAFSGYIDDPFNLNEILPLPASDFKLNTVTNLNEIDFTNIFTKSPHPHSGSTHPRQVFDQLDDCSSILFSPLTTNTNNEFEGESDDFVHSPYLNSEADFSQILSSAPPVHHDPSETHQENQDIIDRFANSSQEHNEYILQYLTHFDAANHNNIGVPNNNSHSLNTQHNVSDLGNPLLRQEALVGSSSTKIFDELKFVQNGPHGSQHPIDFQHVDHRHLSSNEPQVRSHQYGPQQQPPQQLQYHQNQPHDGHNHEQLQTVQKDMQTHESLEIMGNTLLEEFKDIKMVNGELKYVKPED

SEQ ID NO: 222 - DNA, 2073 bp, Saccharomyces cerevisiae
atggaaggcttcaatccggctcacatagaacatgcgtcaccgattaattcatctgacagccattcatcctcctttgtatatgctctacccaaaagtgctagtgaatatgtagtcaaccataatgaggatcgtgcaagtgcaagtggaaatccagccgcagtgccgtctcccataatgacactgaatctcaaaagcacacattccctcaatagtgatcagcatgttcatacctcaacatcgccgacggaaactattgggcatattcatcatgtggaaaagctgaatcaaaacaatttgattcatctggatccagtacccaactttgaagataagtccgatattaagccttggttgcaaaagattttttatcctcaaggaatagaacttgtgatagaaaggtcggacacatttaaagttgtcttcaagtgtaaagctgctaaaaggggaaggaacgcgagaaggaaaagaaaagataagcccaaaggacaggaacacgaagacgagaaatccaagatcaatgatgacgaattagaatatgcgagtccttctaatgccacagtaaccaatgggcctcaaacatcgcccgatcaaacatcctccataaagccaaagaaaaaaagatgtgtatcgaggtttaataactgtccgtttagagtacgagctacttattcgttaaagaggaaaagatggagcattgttgtaatgaacaataaccattcacatcagctaaagtttaaccctgattccgaagagtacaaaaaattcaaagaaaaattaagaaaggataatgacgtagatgcaatcaagaaattcgacgaattggaatacagaactttggccaatttacccattccaacagctacaatcccctgtgattgtggtttaacaaatgaaatacaaagtttcaatgtcgtcttgcccactaacagtaatgttacttcatcagcatcctcttcaactgtatcgtccatatcccttgattcatcgaatgcatctaaaaggccatgcttaccctctgtaaataacaccggtagtatcaataccaataacgtaaggaaaccgaaaagccagtgtaagaataaagacacactcttaaaaagaaccaccatgcagaactttctcacaactaaatcaaggctgcgtaagaccggtacgccaacatcttcgcaacactcatctacagcattttcaggatatattgatgatcctttcaatttgaatgaaatcttgccactgccggcatccgatttcaagctaaacactgtaacaaatttgaacgaaattgactttacgaacatttttaccaaatcgccgcatccacatagcgggtctacccatccaagacaagtcttcgaccaattggacgattgttcctctatactcttctctccattaactacaaacacgaataatgaatttgaaggagagtcagatgattttgttcattctccatatttgaactcagaggcagatttcagccaaattcttagtagtgctcccccagtccatcatgacccaagtgaaacacatcaggaaaaccaggatattattgatagatttgctaatagctcccaagaacataatgagtatattctacaatatttgacgcacttcgatgctgctaaccacaataatatcggcgttccaaacaacaattcacattcgctaaatactcagcataacgtttctgatctgggcaacccacttttaagacaagaagctttagttggcagctcttcaacaaaaatcttcgatgaattgaaatttgtacaaaatggcccacacggttctcaacatcctatagattttcaacatgttgaccatcgtcatctcagctctaatgaacctcaagtacgatcacatcaatatggtccgcaacagcagccaccgcagcaattgcaatatcaccaaaatcagccccacgacgggcataaccacgaacagcttcaaacagtacaaaaggatatgcaaacgcatgaatcgctagaaataatgggaaacacattattggaagagttcaaagacattaaaatggtgaacggcgagttgaagtatgtgaagccagaagattag

SEQ ID NO: 223 - protein, 690 aa, Saccharomyces cerevisiae
MEGFNPAHIEHASPINSSDSHSSSFVYALPKSASEYVVNHNEDRASASGNPAAVPSPIMTLNLKSTHSLNSDQHVHTSTSPTETIGHIHHVEKLNQNNLIHLDPVPNFEDKSDIKPWLQKIFYPQGIELVIERSDTFKVVFKCKAAKRGRNARRKRKDKPKGQEHEDEKSKINDDELEYASPSNATVTNGPQTSPDQTSSIKPKKKRCVSRFNNCPFRVRATYSLKRKRWSIVVMNNNHSHQLKFNPDSEEYKKFKEKLRKDNDVDAIKKFDELEYRTLANLPIPTATIPCDCGLTNEIQSFNVVLPTNSNVTSSASSSTVSSISLDSSNASKRPCLPSVNNTGSINTNNVRKPKSQCKNKDTLLKRTTMQNFLTTKSRLRKTGTPTSSQHSSTAFSGYIDDPFNLNEILPLPASDFKLNTVTNLNEIDFTNIFTKSPHPHSGSTHPRQVFDQLDDCSSILFSPLTTNTNNEFEGESDDFVHSPYLNSEADFSQILSSAPPVHHDPSETHQENQDIIDRFANSSQEHNEYILQYLTHFDAANHNNIGVPNNNSHSLNTQHNVSDLGNPLLRQEALVGSSSTKIFDELKFVQNGPHGSQHPIDFQHVDHRHLSSNEPQVRSHQYGPQQQPPQQLQYHQNQPHDGHNHEQLQTVQKDMQTHESLEIMGNTLLEEFKDIKMVNGELKYVKPED

SEQ ID NO: 224 - DNA, 2073 bp, Saccharomyces cerevisiae
atggaaggcttcaatccggctcacatagaacatgcgtcaccgattaattcatctgacagccattcatcctcctttgtatatgctctacccaaaagtgctagtgaatatgtagtcaaccataatgagggtcgtgcaagtgcaagtggaaatccagccgcagtgccgtctcccataatgacactgaatctcaaaagcacacattccctcaatagtgatcagcatgttcatacctcaacatcgccgacggaaactattgggcatattcatcatgtggaaaagctgaatcaaaacaatttgattcatctggatccagtacccaactttgaagataagtccgatattaagccttggttgcaaaagattttttatcctcaaggaatagaacttgtgatagaaaggtcggacacatttaaagttgtcttcaagtgtaaagctgctaaaaggggaaggaacgcgagaaggaaaagaaaagataagcccaaaggacaggaacacgaagacgagaaatccaagatcaatgatgacgaattagaatatgcgagtccttctaatgccacagtaaccaatgggcctcaaacatcgcccgatcaaacatcctccataaagccaaagaaaaaaagatgtgtatcgaggtttaataactgtccgtttagagtacgagctacttattcgttaaagaggaaaagatggagcattgttgtaatgaacaataaccattcacatcagctaaagtttaaccctgattccgaagagtacaaaaaattcaaagaaaaattaagaaaggataatgacgtagatgcaatcaagaaattcgacgaattggaatacagaactttggccaatttacccattccaacagctacaatcccctgtgattgtggtttaacaaatgaaatacaaagtttcaatgtcgtcttgcccactaacagtaatgttacttcatcagcatcctcttcaactgtatcgtccatatcccttgattcatcgaatgcatctaaaaggccatgcttaccctctgtaaataacaccggtagtatcaataccaataacgtaaggaaaccgaaaagccagtgtaagaataaagacacactcttaaaaagaaccaccatgcagaactttctcacaactaaatcaaggctgcgtaagaccggtacgccaacatcttcgcaacactcatctacagcattttcaggatatattgatgatcctttcaatttgaatgaaatcttgccactgccggcatccgatttcaagctaaacactgtaacaaatttgaacgaaattgactttacgaacatttttaccaaatcgccgcatccacatagcgggtctacccatccaagacaagtcttcgaccaattggacgattgttcctctatactcttctctccattaactacaaacacgaataatgaatttgaaggagagtcagatgattttgttcattctccatatttgaactcagaggcagatttcagccaaattcttagtagtgctcccccagtccatcatgacccaagtgaaacacatcaggaaaaccaggatattattgatagatttgctaatagctcccaagaacataatgagtatattctacaatatttgacgcacttcgatgctgctaaccacaataatatcggcgttccaaacaacaattcacattcgctaaatactcagcataacgtttctgatctgggcaacccacttttaagacaagaagctttagttggcagctcttcaacaaaaatcttcgatgaattgaaatttgtacaaaatggcccacacggttctcaacatcctatagattttcaacatgttgaccatcgtcatctcagctctaatgaacctcaagtacgatcacatcaatatggtccgcaacagcagccaccgcagcaattgcaatatcaccaaaatcagccccacgacgggcataaccacgaacagcttcaaacagtacaaaaggatgtgcaaacgcatgaatcgctagaaataatgggaaacacattattggaagagttcaaagacattaaaatggtgaacggcgagttgaagtatgtgaagccagaagattag

SEQ ID NO: 225 - protein, 690 aa, Saccharomyces cerevisiae
MEGFNPAHIEHASPINSSDSHSSSFVYALPKSASEYVVNHNEGRASASGNPAAVPSPIMTLNLKSTHSLNSDQHVHTSTSPTETIGHIHHVEKLNQNNLIHLDPVPNFEDKSDIKPWLQKIFYPQGIELVIERSDTFKVVFKCKAAKRGRNARRKRKDKPKGQEHEDEKSKINDDELEYASPSNATVTNGPQTSPDQTSSIKPKKKRCVSRFNNCPFRVRATYSLKRKRWSIVVMNNNHSHQLKFNPDSEEYKKFKEKLRKDNDVDAIKKFDELEYRTLANLPIPTATIPCDCGLTNEIQSFNVVLPTNSNVTSSASSSTVSSISLDSSNASKRPCLPSVNNTGSINTNNVRKPKSQCKNKDTLLKRTTMQNFLTTKSRLRKTGTPTSSQHSSTAFSGYIDDPFNLNEILPLPASDFKLNTVTNLNEIDFTNIFTKSPHPHSGSTHPRQVFDQLDDCSSILFSPLTTNTNNEFEGESDDFVHSPYLNSEADFSQILSSAPPVHHDPSETHQENQDIIDRFANSSQEHNEYILQYLTHFDAANHNNIGVPNNNSHSLNTQHNVSDLGNPLLRQEALVGSSSTKIFDELKFVQNGPHGSQHPIDFQHVDHRHLSSNEPQVRSHQYGPQQQPPQQLQYHQNQPHDGHNHEQLQTVQKDVQTHESLEIMGNTLLEEFKDIKMVNGELKYVKPED

What is claimed is:

1. A recombinant yeast microorganism comprising a recombinantly overexpressed polynucleotide encoding a dihydroxy acid dehydratase (DHAD), and recombinantly overexpressed one or more polynucleotides encoding one or more activator of ferrous transport (Aft) proteins which increase the dehydratase activity of DHAD.

2. The recombinant yeast microorganism of claim 1, wherein said recombinant microorganism comprises an isobutanol producing metabolic pathway, said isobutanol producing metabolic pathway comprising the following substrate to product conversions:
    (a) pyruvate to acetolactate;
    (b) acetolactate to 2,3-dihydroxyisovalerate;
    (c) 2,3-dihydroxyisovalerate to a-ketoisovalerate;
    (d) α-ketoisovalerate to isobutyraldehyde; and
    (e) isobutyraldehyde to isobutanol;

and wherein said DHAD catalyzes the conversion of 2,3-dihydroxyisovalerate to α-ketoisovalerate.

3. The recombinant yeast microorganism of claim 2, wherein the enzyme that catalyzes the conversion of pyruvate to acetolactate is an acetolactate synthase.

4. The recombinant yeast microorganism of claim 2, wherein the enzyme that catalyzes the conversion of acetolactate to 2,3-dihydroxyisovalerate is a ketol-acid reductoisomerase.

5. The recombinant yeast microorganism of claim 4, wherein said ketol-acid reductoisomerase is an NADH-dependent ketol-acid reductoisomerase.

6. The recombinant yeast microorganism of claim 2, wherein the enzyme that catalyzes the conversion of α-ketoisovalerate to isobutyraldehyde is a 2-keto acid decarboxylase.

7. The recombinant yeast microorganism of claim 2, wherein the enzyme that catalyzes the conversion of isobutyraldehyde to isobutanol is an alcohol dehydrogenase.

8. The recombinant yeast microorganism of claim 7, wherein said alcohol dehydrogenase is an NADH-dependent alcohol dehydrogenase.

9. The recombinant yeast microorganism of claim 1, wherein said DHAD is localized in the cytosol.

10. The recombinant yeast microorganism of claim 1, wherein said DHAD is localized in the mitochondria.

11. The recombinant yeast microorganism of claim 1, wherein said one or more polynucleotides encoding one or more Aft proteins is a native polynucleotide.

12. The recombinant yeast microorganism of claim 1, wherein said one or more polynucleotides encoding one or more Aft proteins is a heterologous polynucleotide.

13. The recombinant yeast microorganism of claim 1, wherein said Aft protein is selected from SEQ ID NO: 2, SEQ ID NO: 4, SEQ ID NO: 6, SEQ ID NO: 8, SEQ ID NO: 10, SEQ ID NO: 12, SEQ ID NO: 14, SEQ ID NO: 16, SEQ ID NO: 18, SEQ ID NO: 20, SEQ ID NO: 22, SEQ ID NO: 24, SEQ ID NO: 26, SEQ ID NO: 28, SEQ ID NO: 30, SEQ ID NO: 32, SEQ ID NO: 34, SEQ ID NO: 36, SEQ ID NO: 211, SEQ ID NO: 213, SEQ ID NO: 215, SEQ ID NO: 217, SEQ ID NO: 219, SEQ ID NO: 221, SEQ ID NO: 223, and SEQ ID NO: 225.

14. The recombinant yeast microorganism of claim 1, wherein said Aft protein is a constitutively active Aft protein.

15. The recombinant yeast microorganism of claim 14, wherein said constitutively active Aft protein comprises a substitution at a position corresponding to the cysteine 291 residue of the native S. cerevisiae Aft1 protein of SEQ ID NO: 2.

16. The recombinant yeast microorganism of claim 14, wherein said constitutively active Aft protein comprises a mutation substitution at a position corresponding to the cysteine 187 residue of the native S. cerevisiae Aft2 protein of SEQ ID NO: 4.

17. The recombinant yeast microorganism of claim 1, wherein the overexpression of one or more polynucleotides encoding one or more Aft proteins increases the specific activity of DHAD by at least 2-fold in the engineered recombinant yeast microorganism as compared to a corresponding yeast microorganism that is not engineered to overexpress one or more polynucleotides encoding one or more Aft proteins.

18. The recombinant yeast microorganism of claim 1, wherein the recombinant yeast microorganism is a yeast microorganism selected from one of the following genera: *Saccharomyces, Kluyveromyces, Pachysolen, Zygosaccharomyces, Debaryomyces, Pichia, Schizosaccharomyces, Candida, Issatchenkia, Hansenula, Yarrowia, Tricosporon, Rhodotorula*, and *Myxozyma*.

19. The recombinant yeast microorganism of claim 1, wherein the recombinant yeast microorganism is a yeast microorganism selected from one of the following species: *Saccharomyces cerevisiae, Saccharomyces uvarum, Saccharomyces bayanus, Saccharomyces paradoxus, Saccharomyces castelli, Saccharomyces kluyveri, Kluyveromyces thermotolerans, Kluyveromyces lactis, Kluyveromyces marxianus, Kluyveromyces waltii, Pachysolen tannophilis, Zygosaccharomyces bailli, Zygosaccharomyces rouxii, Debaryomyces hansenii, Debaromyces carsonii, Pichia pastorius, Pichia anomala, Pichia stipitis, Pichia castillae, Schizosaccharomyces pombe, Candida utilis, Candida glabrata, Candida tropicalis, Candida xestobii, Issatchenkia orientalis, Issatchenkia occidentalis, Issatchenkia scutulata, Hansenula anomala*, and *Yarrowia lipolytica*.

20. A method of producing isobutanol comprising: (a) providing the recombinant yeast microorganism of claim 2; and (b) cultivating the recombinant yeast microorganism of claim 2 in a culture medium containing a feedstock providing a carbon source, until a recoverable quantity of the isobutanol is produced.

* * * * *

(12) INTER PARTES REEXAMINATION CERTIFICATE (1182nd)
United States Patent
Dundon et al.

(10) Number: US 8,017,376 C1
(45) Certificate Issued: Sep. 29, 2015

(54) METHODS OF INCREASING DIHYDROXY ACID DEHYDRATASE ACTIVITY TO IMPROVE PRODUCTION OF FUELS, CHEMICALS, AND AMINO ACIDS

(75) Inventors: Catherine Asleson Dundon, Englewood, CO (US); Aristos Aristidou, Highlands Ranch, CO (US); Andrew Hawkins, Parker, CO (US); Doug Lies, Parker, CO (US); Lynne H. Albert, Golden, CO (US)

(73) Assignee: GEVO, INC., Englewood, CO (US)

Reexamination Request:
No. 95/001,870, Jan. 10, 2012

Reexamination Certificate for:
Patent No.: 8,017,376
Issued: Sep. 13, 2011
Appl. No.: 12/953,884
Filed: Nov. 24, 2010

Related U.S. Application Data

(60) Provisional application No. 61/263,952, filed on Nov. 24, 2009, provisional application No. 61/350,209, filed on Jun. 1, 2010.

(51) Int. Cl.
| | |
|---|---|
| *C12N 9/88* | (2006.01) |
| *C07H 21/02* | (2006.01) |
| *C12P 7/16* | (2006.01) |
| *C12P 13/02* | (2006.01) |
| *C12P 13/06* | (2006.01) |
| *C12P 13/08* | (2006.01) |
| *C07K 14/395* | (2006.01) |

(52) U.S. Cl.
CPC ............... *C12N 9/88* (2013.01); *C07K 14/395* (2013.01); *C12P 7/16* (2013.01); *C12P 13/02* (2013.01); *C12P 13/06* (2013.01); *C12P 13/08* (2013.01); *C12Y 402/01009* (2013.01); *Y02E 50/10* (2013.01)

(58) Field of Classification Search
None
See application file for complete search history.

(56) References Cited

To view the complete listing of prior art documents cited during the proceeding for Reexamination Control Number 95/001,870, please refer to the USPTO's public Patent Application Information Retrieval (PAIR) system under the Display References tab.

*Primary Examiner* — Gary Kunz

(57) ABSTRACT

The present invention is directed to recombinant microorganisms comprising one or more dihydroxyacid dehydratase (DHAD)-requiring biosynthetic pathways and methods of using said recombinant microorganisms to produce beneficial metabolites derived from said DHAD-requiring biosynthetic pathways. In various aspects of the invention, the recombinant microorganisms may be engineered to overexpress one or more polynucleotides encoding one or more Aft proteins or homologs thereof. In some embodiments, the recombinant microorganisms may comprise a cytosolically localized DHAD enzyme. In additional embodiments, the recombinant microorganisms may comprise a mitochondrially localized DHAD enzyme. In various embodiments described herein, the recombinant microorganisms may be microorganisms of the Saccharomyces clade, Crabtree-negative yeast microorganisms, Crabtree-positive yeast microorganisms, post-WGD (whole genome duplication) yeast microorganisms, pre-WGD (whole genome duplication) yeast microorganisms, and non-fermenting yeast microorganisms.

INTER PARTES REEXAMINATION CERTIFICATE

THE PATENT IS HEREBY AMENDED AS INDICATED BELOW.

Matter enclosed in heavy brackets [ ] appeared in the patent, but has been deleted and is no longer a part of the patent; matter printed in italics indicates additions made to the patent.

AS A RESULT OF REEXAMINATION, IT HAS BEEN DETERMINED THAT:

The patentability of claims 3-9, 16 and 20 is confirmed.

Claims 1, 10, 13 and 15 are cancelled.

Claims 2, 11, 12, 14 and 17-19 are determined to be patentable as amended.

2. The recombinant yeast microorganism of claim [1] *9*, wherein said recombinant microorganism comprises an isobutanol producing metabolic pathway, said isobutanol producing metabolic pathway comprising the following substrate to product conversions: (a) pyruvate to acetolactate; (b) acetolactate to 2,3-dihydroxyisovalerate; (c) 2,3-dihydroxyisovalerate to α-ketoisovalerate; (d) α-ketoisovalerate to isobutyraldehyde; and (e) isobutyraldehyde to isobutanol; and wherein said DHAD catalyzes the conversion of 2,3-dihydroxyisovalerate to α-ketoisovalerate.

11. The recombinant yeast microorganism of claim [1] *9*, wherein said one or more polynucleotides encoding one or more Aft proteins is a native polynucleotide.

12. The recombinant yeast microorganism of claim [1] *9*, wherein said one or more polynucleotides encoding one or more Aft proteins is a heterologous polynucleotide.

14. The recombinant yeast microorganism of claim [1] *9*, wherein said Aft protein is a constitutively active Aft protein.

17. The recombinant yeast microorganism of claim [1] *9*, wherein the overexpression of one or more polynucleotides encoding one or more Aft proteins increases the specific activity of DHAD by at least 2-fold in the engineered recombinant yeast microorganism as compared to a corresponding yeast microorganism that is not engineered to overexpress one or more polynucleotides encoding one or more Aft proteins.

18. The recombinant yeast microorganism of claim [1] *9*, wherein the recombinant yeast microorganism is a yeast microorganism selected from one of the following genera: Saccharomyces, Kluyveromyces, Pachysolen, Zygosaccharomyces, Debaryomyces, Pichia, Schizosaccharomyces, Candida, Issatchenkia, Hansenula, Yarrowia, Tricosporon, Rhodotorula, and Myxozyma.

19. The recombinant yeast microorganism of claim [1] *9*, wherein the recombinant yeast microorganism is a yeast microorganism selected from one of the following species: Saccharomyces cerevisiae, Saccharomyces uvarum, Saccharomyces bayanus, Saccharomyces paradoxus, Saccharomyces castelli, Saccharomyces kluyveri, Kluyveromyces thermotolerans, Kluyveromyces lactis, Kluyveromyces marxianus, Kluyveromyces waltii, Pachysolen tannophilis, Zygosaccharomyces bailli, Zygosaccharomyces rouxii, Debaryomyces hansenii, [Debaromyces carsonii,] Pichia pastorius, Pichia anomala, Pichia stipitis, [Pichia castillae,] Schizosaccharomyces pombe, Candida utilis, Candida glabrata, Candida tropicalis, [Candida xestobii,] Issatchenkia orientalis, Issatchenkia occidentalis, Issatchenkia scutulata, Hansenula anomala, and Yarrowia lipolytica.

\* \* \* \* \*